United States Patent
Sahin et al.

(10) Patent No.: US 10,457,735 B2
(45) Date of Patent: Oct. 29, 2019

(54) METHODS OF INDUCING T CELL ACTIVATION BY ADMINISTERING AN ANTIBODY COMPRISING CD40 AND 4-1BB (CD137) BINDING DOMAINS

(71) Applicants: BIONTECH AG, Mainz (DE); GENMAB A/S, Copenhagen (DK)

(72) Inventors: Ugur Sahin, Mainz (DE); Friederike Gieseke, Mainz (DE); Isil Altintas, Utrecht (NL); David Satijn, Utrecht (NL); Paul Parren, Utrecht (NL)

(73) Assignees: BIONTECH SE, Mainz (DE); GENMAB A/S, Copenhagen (DE)

( * ) Notice: Subject to any disclaimer, the term of this patent is extended or adjusted under 35 U.S.C. 154(b) by 0 days.

(21) Appl. No.: 15/538,419

(22) PCT Filed: Jan. 8, 2016

(86) PCT No.: PCT/EP2016/050308
§ 371 (c)(1),
(2) Date: Jun. 21, 2017

(87) PCT Pub. No.: WO2016/110584
PCT Pub. Date: Jul. 14, 2016

(65) Prior Publication Data
US 2018/0194849 A1    Jul. 12, 2018

(30) Foreign Application Priority Data
Jan. 8, 2015  (EP) .................. PCT/EP2015/050255

(51) Int. Cl.
*C07K 16/28*    (2006.01)

(52) U.S. Cl.
CPC ...... *C07K 16/2878* (2013.01); *C07K 2317/31* (2013.01); *C07K 2317/565* (2013.01); *C07K 2317/75* (2013.01); *C07K 2317/92* (2013.01)

(58) Field of Classification Search
CPC ............ C07K 16/2878; C07K 2317/31; C07K 2317/565; C07K 2317/75; C07K 2317/92
See application file for complete search history.

(56) References Cited

U.S. PATENT DOCUMENTS

2010/0303811 A1    12/2010    Ochi

FOREIGN PATENT DOCUMENTS

| WO | 2008051424 A2 | 5/2008 |
| WO | 2009034172 A1 | 3/2009 |

OTHER PUBLICATIONS

Paul, WE. Fundamental Immunology, 3rd ed. Raven Press, NY, Chap. 9, pp. 292-295, 1993.*
Rudikoff S. et al. Proc. Natl. Acad. Sci. USA, 79:1979-1983, 1982.*
Colman, PM. Research in Immunology, Elsevier, NY, 145(1):33-36, 1994.*
Testuo Hirano et al., "CD27 Synergizes with CD40 to Induce IgM, IgG, and IgA Antibody Responses of Peripheral Blood B Cells in the Presence of IL-2 and IL-10", Immunology Letters, Elsevier BV, NL, vol. 89, No. 2-3, Oct. 31, 2003, pp. 251-257, XP002582840.
Jennifer Westwood, et al., "Combination Anti-CD137 and Anti-CD40 Antibody Therapy in Murine myc-Driven Hematological Cancers", Leukemia Research, vol. 38, No. 8, Jun. 2, 2014, pp. 948-954, XP029038939.
Ruth French, et al., "Eradication of Lymphoma by CD8 T Cells following Anti-CD40 Monoclonal Antibody Therapy is Critically Dependent on CD27 Costimulation", Blood, American Society of Hematology, US., vol. 109, No. 11, Jun. 1, 2007, pp. 4810-4815, XP002582844.
Brenda De Keersmaecker et al., "The Combination of 4-1BBL and CD40L Strongly Enhances the Capacity of Dendritic Cells to Stimulate HIV-Specific T Cell Responses", Journal of Leukocyte Biology, vol. 89, No. 6, Jun. 1, 2011, pp. 989-999, XP055276241.
PCT International Search Report dated Jun. 8, 2016 for PCT Patent Application No. PCT/EP2016/050308.

* cited by examiner

*Primary Examiner* — Robert S Landsman
(74) *Attorney, Agent, or Firm* — McAndrews, Held & Malloy, Ltd.

(57) ABSTRACT

The present invention relates to binding agents binding to receptors of the TNF superfamily, in particular binding agents binding to at least two different receptors of the TNF superfamily, as well as to their use in medicine. The present invention further relates to nucleic acid molecules encoding such binding agents, to cells comprising such nucleic acid molecules and to pharmaceutical compositions and kits.

3 Claims, 20 Drawing Sheets
Specification includes a Sequence Listing.

METHODS OF INDUCING T CELL ACTIVATION BY ADMINISTERING AN ANTIBODY COMPRISING CD40 AND 4-1BB (CD137) BINDING DOMAINS

TECHNICAL FIELD OF THE INVENTION

The present invention relates to binding agents binding to receptors of the TNF superfamily, in particular binding agents binding to at least two different receptors of the TNF superfamily, as well as to their use in medicine. The present invention further relates to nucleic acid molecules encoding such binding agents, to cells comprising such nucleic acid molecules and to pharmaceutical compositions and kits.

BACKGROUND OF THE INVENTION

Receptors for tumor necrosis factor (TNF) superfamily ligands are oligomeric, mostly trimeric, type I or type III transmembrane proteins and contain one to six cysteine-rich domains (CRDs) in their extracellular domain (Naismith J. H. and Sprang S. R. (1998), TRENDS in Biochemical Sciences 23(2):74-79). Moreover, several receptors for TNF superfamily ligands contain death domains (DDs) that recruit caspase-interacting proteins following ligand binding to initiate the extrinsic pathway of caspase activation.

Numerous receptors of the TNF superfamily have been identified so far, including 4-1BB (CD137), BAFFR, BCMA, CD27, CD30, CD40, DCR3, DR3 (TRAMP), DR6, EDAR, Fas (CD95) FN14 (TWEAK-R) GITR, HVEM LTβR, NGFR (CD271), OPG, OX40 (CD134), RANK (TRANCE-R), RELT, TACI, TNFR1, TNFR2, TRAIL-R1, TRAIL-R2, TRAIL-R3, TRAIL-R4, TROY and XEDAR (Bodmer, J. L. et al. (2002), TRENDS in Biochemical Sciences, 27(1):19-26).

Through timely expression and intricate signaling, receptors of the TNF superfamily and their corresponding ligands act to regulate cell responses, including activation, proliferation, differentiation, and apoptosis. While critical to the regulation of beneficial processes, such as immune defense and hematopoiesis, TNF signaling is also implicated in tumorigenesis, transplant rejection, virus replication, bone resorption, diabetes and autoimmune diseases.

Agonistic agents specifically binding to one or more receptors of the TNF superfamily are, therefore, considered as potential therapeutics in the prevention and/or treatment of various diseases and disorders.

Accordingly, it was an object of the present invention to provide novel agonistic binding agents targeting receptors of the TNF superfamily, in particular agonistic binding agents targeting at least two different receptors of the TNF superfamily.

SUMMARY OF THE INVENTION

In one aspect, the present invention relates to a binding agent comprising at least two binding domains, wherein a first binding domain binds to a first receptor of the tumor necrosis factor (TNF) superfamily and a second binding domain binds to a second receptor of the TNF superfamily, wherein the first receptor and the second receptor are different.

In one embodiment, the binding agent is an agonistic binding agent.

In one embodiment, the binding agent is a bispecific molecule, preferably a bispecific antibody.

In one embodiment, the binding agent is in the format of a full-length antibody or an antibody fragment.

In one embodiment, the first receptor and the second receptor are selected from the group consisting of CD40, CD27, OX40 (CD134) and 4-1BB (CD137).

In one embodiment, the first binding domain or the second binding domain binds to CD27, wherein the binding agent comprises
(a) the heavy chain complementarity determining region(s) HCDR1, HCDR2 and/or HCDR3, and/or
the light chain complementarity determining region(s) LCDR1, LCDR2 and/or LCDR3 of an antibody selected from the group consisting of AB27_1 to AB27_186 as shown in Table 7; and/or
(b) the heavy chain variable domain (VH) or a variant or fragment thereof and/or the light chain variable domain (VL) or a variant or fragment thereof
of an antibody selected from the group consisting of AB27_1 to AB27_186 as shown in Table 7.

In one embodiment, the first binding domain or the second binding domain binds to OX40 (CD134), wherein the binding agent comprises
(a) the heavy chain complementarity determining region(s) HCDR1, HCDR2 and/or HCDR3, and/or
the light chain complementarity determining region(s) LCDR1, LCDR2 and/or LCDR3 of an antibody selected from the group consisting of AB134_1 to AB134_92 as shown in Table 8; and/or
(b) the heavy chain variable domain (VH) or a variant or fragment thereof and/or the light chain variable domain (VL) or a variant or fragment thereof
of an antibody selected from the group consisting of AB134_1 to AB134_92 as shown in Table 8.

In one embodiment, the first binding domain or the second binding domain binds to 4-1BB (CD137), wherein the binding agent comprises
(a) the heavy chain complementarity determining region(s) HCDR1, HCDR2 and/or HCDR3, and/or
the light chain complementarity determining region(s) LCDR1, LCDR2 and/or LCDR3 of an antibody selected from the group consisting of AB137_1 to AB137_12 as shown in Table 9; and/or
(b) the heavy chain variable domain (VH) or a variant or fragment thereof and/or the light chain variable domain (VL) or a variant or fragment thereof
of an antibody selected from the group consisting of AB137_1 to AB137_12 as shown in Table 9.

In one embodiment, the first binding domain or the second binding domain binds to CD40, wherein the binding agent comprises
(a) heavy chain complementarity determining region(s) HCDR1 having the amino acid sequence of SEQ ID NO: 2323, HCDR2 having the amino acid sequence of SEQ ID NO: 2324 and/or HCDR3 having the amino acid sequence of SEQ ID NO: 2325, and/or light chain complementarity determining region(s) LCDR1 having the amino acid sequence of SEQ ID NO: 2326, LCDR2 having the amino acid sequence of SEQ ID NO: 2327 and/or LCDR3 having the amino acid sequence of SEQ ID NO: 2328; and/or
(b) heavy chain variable domain (VH) having the amino acid sequence of SEQ ID NO: 2321 or a variant or fragment thereof and/or light chain variable domain (VL) having the amino acid sequence of SEQ ID NO: 2322 or a variant or fragment thereof.

In one embodiment,
(a) the first binding domain binds to CD40 and the second binding domain binds to CD27;
(b) the first binding domain binds to CD40 and the second binding domain binds to OX40 (CD134);
(c) the first binding domain binds to CD40 and the second binding domain binds to 4-1BB (CD137);
(d) the first binding domain binds to 4-1BB (CD137) and the second binding domain binds to CD27;
(e) the first binding domain binds to 4-1 BB (CD137) and the second binding domain binds to OX40 (CD134); or
(f) the first binding domain binds to OX40 (CD134) and the second binding domain binds to CD27.

In one embodiment, the binding agent comprises one or more heavy chain constant domains of an immunoglobulin and/or light chain constant domains of an immunoglobulin.

In another aspect, the present invention relates to a binding agent that binds to CD27, comprising
(a) the heavy chain complementarity determining region(s) HCDR1, HCDR2 and/or HCDR3, and/or
the light chain complementarity determining region(s) LCDR1, LCDR2 and/or LCDR3 of an antibody selected from the group consisting of AB27_1 to AB27_186 as shown in Table 7; and/or
(b) the heavy chain variable domain (VH) or a variant or fragment thereof and/or the light chain variable domain (VL) or a variant or fragment thereof
of an antibody selected from the group consisting of AB27_1 to AB27_186 as shown in Table 7.

In another aspect, the present invention relates to a binding agent that binds to OX40 (CD134), comprising
(a) the heavy chain complementarity determining region(s) HCDR1, HCDR2 and/or HCDR3, and/or
the light chain complementarity determining region(s) LCDR1, LCDR2 and/or LCDR3 of an antibody selected from the group consisting of AB134_1 to AB134_92 as shown in Table 8; and/or
(b) the heavy chain variable domain (VH) or a variant or fragment thereof and/or the light chain variable domain (VL) or a variant or fragment thereof
of an antibody selected from the group consisting of AB134_1 to AB134_92 as shown in Table 8.

In another aspect, the present invention relates to a binding agent that binds to 4-1BB (CD137), comprising
(a) the heavy chain complementarity determining region(s) HCDR1, HCDR2 and/or HCDR3, and/or
the light chain complementarity determining region(s) LCDR1, LCDR2 and/or LCDR3 of an antibody selected from the group consisting of AB137_1 to AB137_12 as shown in Table 9; and/or
(b) the heavy chain variable domain (VH) or a variant or fragment thereof and/or the light chain variable domain (VL) or a variant or fragment thereof
of an antibody selected from the group consisting of AB137_1 to AB137_12 as shown in Table 9.

In one embodiment, the binding agent is an agonistic binding agent.

In one embodiment, the binding agent is in the format of a full-length antibody or an antibody fragment.

In one embodiment, the binding agent comprises one or more heavy chain constant domains of an immunoglobulin and/or light chain constant domains of an immunoglobulin.

In another aspect, the present invention relates to a binding agent binding to the same epitope(s) as a binding agent as defined above.

In another aspect, the present invention relates to a nucleic acid molecule encoding a binding agent as defined above, wherein, preferably, the nucleic acid molecule is contained in a vector.

In another aspect, the present invention relates to a cell comprising a nucleic acid molecule as defined above.

In another aspect, the present invention relates to a pharmaceutical composition comprising, as an active agent, a binding agent as defined above, a nucleic acid molecule as defined above, or a cell as defined above.

In one embodiment, the pharmaceutical composition further comprises a pharmaceutically acceptable carrier and/or excipient.

In another aspect, the present invention relates to a kit comprising a binding agent as defined above, a nucleic acid molecule as defined above, a cell as defined above, or a pharmaceutical composition as defined above.

In another aspect, the present invention relates to a binding agent as defined above, a nucleic acid molecule as defined above, a cell as defined above, or a pharmaceutical composition as defined above for use as a medicament.

In another aspect, the present invention relates to a binding agent as defined above, a nucleic acid molecule as defined above, a cell as defined above, or a pharmaceutical composition as defined above for use in the treatment of a disease selected from the group consisting of cancer, infectious diseases, inflammatory diseases, metabolic diseases, autoimmune disorders, degenerative diseases, apoptosis-associated diseases and transplant rejections.

DETAILED DESCRIPTION OF THE INVENTION

Figure 1A:
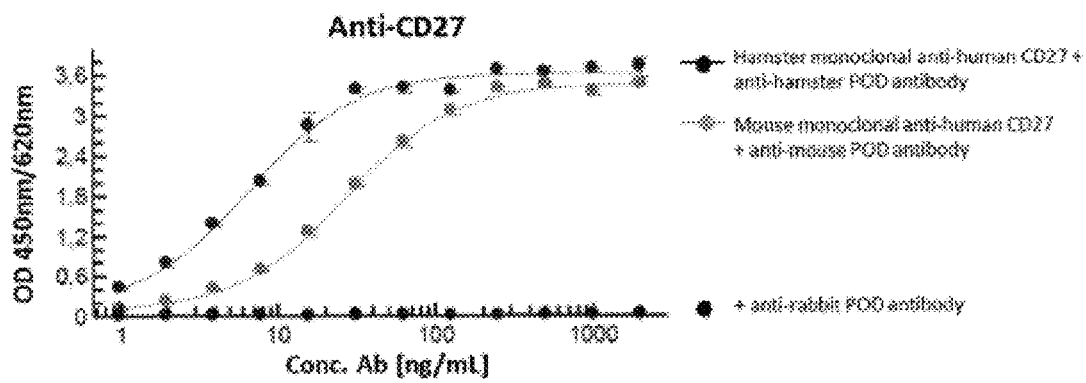
FIGS. 1A-1C show binding curves of reference antibodies against CD27, CD134 and CD137 to the respective recombinant protein, as determined by enzyme-linked immunosorbent assay (ELISA).

Although the present invention is described in detail below, it is to be understood that this invention is not limited to the particular methodologies, protocols and reagents described herein as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art.

In the following, the elements of the present invention will be described. These elements are listed with specific embodiments, however, it should be understood that they may be combined in any manner and in any number to create additional embodiments. The variously described examples and preferred embodiments should not be construed to limit the present invention to only the explicitly described embodiments. This description should be understood to support and encompass embodiments which combine the explicitly described embodiments with any number of the disclosed and/or preferred elements. Furthermore, any permutations and combinations of all described elements in this application should be considered disclosed by the description of the present application unless the context indicates otherwise.

Preferably, the terms used herein are defined as described in "A multilingual glossary of biotechnological terms: (IUPAC Recommendations)", H. G. W. Leuenberger, B. Nagel, and H. Kölbl, Eds., Helvetica Chimica Acta, CH-4010 Basel, Switzerland, (1995).

The practice of the present invention will employ, unless otherwise indicated, conventional methods of chemistry, biochemistry, cell biology, immunology, and recombinant DNA techniques which are explained in the literature in the field (cf., e.g., Molecular Cloning: A Laboratory Manual, $2^{nd}$ Edition, J. Sambrook et al. eds., Cold Spring Harbor Laboratory Press, Cold Spring Harbor 1989).

Throughout this specification and the claims which follow, unless the context requires otherwise, the word "comprise", and variations such as "comprises" and "comprising", will be understood to imply the inclusion of a stated member, integer or step or group of members, integers or steps but not the exclusion of any other member, integer or step or group of members, integers or steps although in some embodiments such other member, integer or step or group of members, integers or steps may be excluded, i.e. the subject-matter consists in the inclusion of a stated member, integer or step or group of members, integers or steps. The terms "a" and "an" and "the" and similar reference used in the context of describing the invention (especially in the context of the claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g., "such as"), provided herein is intended merely to better illustrate the invention and does not pose a limitation on the scope of the invention otherwise claimed. No language in the specification should be construed as indicating any non-claimed element essential to the practice of the invention.

Several documents are cited throughout the text of this specification. Each of the documents cited herein (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention.

The term "receptor of the TNF superfamily" preferably refers to a receptor selected from the group consisting of 4-1BB (CD137), BAFFR, BCMA, CD27, CD30, CD40, DCR3, DR3 (TRAMP), DR6, EDAR, Fas (CD95), FN14 (TWEAK-R), GITR, HVEM, LTβR, NGFR (CD271), OPG, OX40 (CD134), RANK (TRANCE-R), RELT, TACI, TNFR1, TNFR2, TRAIL-R1, TRAIL-R2, TRAIL-R3, TRAIL-R4, TROY and XEDAR.

The term "receptor of the TNF superfamily", as used herein, also includes variants of a given receptor of the TNF superfamily.

The term "variant" according to the invention refers, in particular, to mutants, splice variants, conformation variants, isoforms, allelic variants, species variants and species homologs, in particular those which are naturally present. An allelic variant relates to an alteration in the normal sequence of a gene, the significance of which is often unclear. Complete gene sequencing often identifies numerous allelic variants for a given gene. A species homolog is a nucleic acid or amino acid sequence with a different species of origin from that of a given nucleic acid or amino acid sequence. The term "variant" shall encompass any posttranslationally modified variants and conformation variants.

According to the present invention, the first receptor and the second receptor of the TNF superfamily are preferably selected from the group consisting of CD40, CD27, OX40 (CD134) and 4-1BB (CD137).

CD40, also referred to as tumor necrosis factor receptor superfamily member 5 (TNFRSF5), is the receptor for the ligand TNFSF5/CD40L. CD40 is known to transduce TRAF6- and MAP3K8-mediated signals that activate ERK in macrophages and B-cells, leading to induction of immunoglobulin secretion. In one embodiment, CD40 is human CD40, having UniProt accession number P25942.

CD27, also referred to as TNFRSF7, is the receptor for the ligand CD70/CD27L. CD27 is believed to play a role in survival of activated T cells and a role in apoptosis through association with SIVA1. In one embodiment, CD27 is human CD27, having UniProt accession number P26842.

OX40 (CD134), also referred to as TNFRSF4, is the receptor for the ligand TNFSF4/OX40L/GP34. OX40 (CD134) is a costimulatory molecule implicated in long-term T cell immunity. In one embodiment, OX40 (CD134) is human OX40 (CD134), having UniProt accession number P43489.

4-1BB (CD137), also referred to as TNFRSF9, is the receptor for the ligand TNFSF9/4-1BBL. 4-1BB (CD137) is believed to be involved in T cell activation. In one embodiment, 4-1BB (CD137) is human 4-1BB (CD137), having UniProt accession number Q07011.

The term "binding domain" characterizes in connection with the present invention a structure, e.g., of an antibody, which binds to/interacts with a given target structure/antigen/epitope. Thus, the binding domain according to the invention designates an "antigen-interaction site" or "antigen-binding site".

The term "antigen" relates to an agent such as a protein or peptide comprising an epitope against which an immune response is directed and/or is to be directed.

The term "peptide" according to the invention comprises oligo- and polypeptides and refers to substances comprising two or more, preferably 3 or more, preferably 4 or more, preferably 6 or more, preferably 8 or more, preferably 9 or more, preferably 10 or more, preferably 13 or more, preferably 16 more, preferably 21 or more and up to preferably 8, 10, 20, 30, 40 or 50, in particular 100 amino acids joined covalently by peptide bonds. The term "protein" refers to large peptides, preferably to peptides with more than 100 amino acid residues, but in general the terms "peptides" and "proteins" are synonyms and are used interchangeably herein.

The term "epitope" refers to an antigenic determinant in a molecule, i.e., to the part in a molecule that is recognized by the immune system, for example, that is recognized by an antibody. For example, epitopes are the discrete, three-dimensional sites on an antigen, which are recognized by the immune system. Epitopes usually consist of chemically active surface groupings of molecules such as amino acids or sugar side chains and usually have specific three dimensional structural characteristics, as well as specific charge characteristics. Conformational and non-conformational epitopes are distinguished in that the binding to the former but not the latter is lost in the presence of denaturing solvents. An epitope of a protein preferably comprises a continuous or discontinuous portion of said protein and is preferably between 5 and 100, preferably between 5 and 50, more preferably between 8 and 30, most preferably between 10 and 25 amino acids in length, for example, the epitope may be preferably 8, 9, 10, 11, 12, 13, 14, 15, 16, 17, 18, 19, 20, 21, 22, 23, 24, or 25 amino acids in length.

Mapping of epitopes recognized by binding agents can be performed as described in detail in "Epitope Mapping Protocols" (Methods in Molecular Biology) by Glenn E. Morris ISBN-089603-375-9 and in "Epitope Mapping: A Practical Approach" Practical Approach Series, 248 by Olwyn M. R. Westwood, Frank C. Hay.

The term "agonistic binding agent", as used herein, refers to a binding agent, which activates the receptor(s) of the TNF superfamily it is binding to. In one embodiment, the binding agent induces IL-8 release from and/or activates the NF-κB pathway in the cell(s) expressing the receptor(s) of the TNF superfamily it is binding to. In one embodiment, the binding agent is a trans-activating binding agent, simultaneously activating receptors of the TNF superfamily, e.g., said first and second receptor, located on different cells. In another embodiment, the binding agent is a cis-activating binding agent, simultaneously activating receptors of the TNF superfamily, e.g., said first and second receptor, located on the same cell.

The term "binding" according to the invention preferably relates to a specific binding. A binding agent, such as an antibody or fragment thereof, is specific for a predetermined target if it is capable of binding to said predetermined target while it is not (substantially) capable of binding to other targets.

According to the present invention, a binding agent, such as an antibody or fragment thereof, is capable of binding to a predetermined target if it has a significant affinity for said predetermined target and binds to said predetermined target in standard assays. "Affinity" or "binding affinity" is often measured by equilibrium dissociation constant ($K_D$). Preferably, the term "significant affinity" refers to the binding to a predetermined target with a dissociation constant ($K_D$) of $10^{-5}$ M or lower, $10^{-6}$ M or lower, $10^{-7}$ M or lower, $10^{-8}$ M or lower, $10^{-9}$ M or lower, $10^{-10}$ M or lower, $10^{-11}$ M or lower, or $10^{-12}$ M or lower.

An agent is not (substantially) capable of binding to a target if it has no significant affinity for said target and does not bind significantly, in particular does not bind detectably, to said target in standard assays. Preferably, the agent does not detectably bind to said target if present in a concentration of up to 2, preferably 10, more preferably 20, in particular 50 or 100 μg/ml or higher. Preferably, an agent has no significant affinity for a target if it binds to said target with a $K_D$ that is at least 10-fold, 100-fold, $10^3$-fold, $10^4$-fold, $10^5$-fold, or $10^6$-fold higher than the $K_D$ for binding to the predetermined target to which the agent is capable of binding. For example, if the $K_D$ for binding of an agent to the target to which the agent is capable of binding is $10^{-7}$ M, the $K_D$ for binding to a target for which the agent has no significant affinity would be at least $10^{-6}$ M, $10^{-5}$ M, $10^{-4}$ M, $10^{-3}$ M, $10^{-2}$ M, or $10^{-1}$ M.

Binding of an agent to a target can be determined experimentally using any suitable method; see, for example, Berzofsky et al., "Antibody-Antigen Interactions" In Fundamental Immunology, Paul, W. E., Ed., Raven Press New York, N.Y. (1984), Kuby, Janis Immunology, W. H. Freeman and Company New York, N.Y. (1992), and methods described herein. Affinities may be readily determined using conventional techniques, such as by equilibrium dialysis; by using the BIAcore 2000 instrument, using general procedures outlined by the manufacturer; by radioimmunoassay using radiolabeled target antigen; or by another method known to the skilled artisan. The affinity data may be analyzed, for example, by the method of Scatchard et al., Ann N.Y. Acad. ScL, 51:660 (1949). The measured affinity of a particular antibody-antigen interaction can vary if measured under different conditions, e.g., salt concentration, pH. Thus, measurements of affinity and other antigen-binding parameters, e.g., $K_D$, $IC_{50}$, are preferably made with standardized solutions of antibody and antigen, and a standardized buffer.

The term "antibody" refers to a glycoprotein comprising at least two heavy (H) chains and two light (L) chains inter-connected by disulfide bonds. The term "antibody" includes monoclonal antibodies, recombinant antibodies, human antibodies, humanized antibodies, chimeric antibodies and combinations of any of the foregoing. Each heavy chain is comprised of a heavy chain variable region (VH) and a heavy chain constant region (CH). Each light chain is comprised of a light chain variable region (VL) and a light chain constant region (CL). The variable regions and constant regions are also referred to herein as variable domains and constant domains, respectively. The VH and VL regions can be further subdivided into regions of hypervariability, termed complementarity determining regions (CDRs), interspersed with regions that are more conserved, termed framework regions (FRs). Each VH and VL is composed of three CDRs and four FRs, arranged from amino-terminus to carboxy-terminus in the following order: FR1, CDR1, FR2, CDR2, FR3, CDR3, FR4. The CDRs of a VH are termed HCDR1, HCDR2 and HCDR3, the CDRs of a VL are termed LCDR1, LCDR2 and LCDR3. The variable regions of the heavy and light chains contain a binding domain that interacts with an antigen. The constant regions of an antibody comprise the heavy chain constant region (CH) and the light chain constant region (CL), wherein CH can be further subdivided into constant domain CH1, a hinge region, and constant domains CH2 and CH3 (arranged from amino-terminus to carboxy-terminus in the following order: CH1, CH2, CH3). The constant regions of the antibodies may mediate the binding of the immunoglobulin to host tissues or factors, including various cells of the immune system (e.g., effector cells) and the first component (C1q) of the classical complement system.

Antibodies may be derived from different species, including but not limited to mouse, rat, rabbit, guinea pig and human.

Antibodies described herein include IgA such as IgA1 or IgA2, IgG1, IgG2, IgG3, IgG4, IgE, IgM, and IgD antibodies. In various embodiments, the antibody is an IgG1 antibody, more particularly an IgG1, kappa or IgG1, lambda isotype (i.e. IgG1, κ, λ), an IgG2a antibody (e.g. IgG2a, κ, λ), an IgG2b antibody (e.g. IgG2b, κ, λ), an IgG3 antibody (e.g. IgG3, κ, λ) or an IgG4 antibody (e.g. IgG4, κ, λ).

As used herein, "isotype" refers to the antibody class (e.g., IgM or IgG1) that is encoded by heavy chain constant region genes. "Isotype switching" refers to the phenomenon by which the class, or isotype, of an antibody changes from one Ig class to one of the other Ig classes.

The term "monoclonal antibody", as used herein, refers to a preparation of antibody molecules of single molecular composition. A monoclonal antibody displays a single binding specificity and affinity. In one embodiment, the monoclonal antibodies are produced by a hybridoma which includes a B-cell obtained from a non-human animal, e.g., a mouse, fused to an immortalized cell.

The term "recombinant antibody", as used herein, includes all antibodies that are prepared, expressed, created or isolated by recombinant means, such as (a) antibodies isolated from an animal (e.g., a mouse) that is transgenic or transchromosomal with respect to the immunoglobulin genes or a hybridoma prepared therefrom, (b) antibodies isolated from a host cell transformed to express the antibody, e.g., from a transfectoma, (c) antibodies isolated from a recombinant, combinatorial antibody library, and (d) antibodies prepared, expressed, created or isolated by any other means that involve splicing of immunoglobulin gene sequences to other DNA sequences.

The term "recombinant" in the context of the present invention means "made through genetic engineering". Preferably, a "recombinant object", such as a recombinant antibody or nucleic acid" is not naturally occurring.

The term "naturally occurring", as used herein, as applied to an object refers to the fact that an object can be found in nature. For example, a polypeptide or polynucleotide sequence that is present in an organism (including viruses) that can be isolated from a source in nature and which has not been intentionally modified by man in the laboratory is naturally occurring.

The term "human antibody", as used herein, is intended to include antibodies having variable and constant regions derived from human germline immunoglobulin sequences. Human antibodies may include amino acid residues not encoded by human germline immunoglobulin sequences (e.g., mutations introduced by random or site-specific mutagenesis in vitro or by somatic mutation in vivo).

The term "humanized antibody" refers to a molecule having an antigen binding site that is substantially derived from an immunoglobulin from a non-human species, wherein the remaining immunoglobulin structure of the molecule is based upon the structure and/or sequence of a human immunoglobulin. The antigen binding site may either comprise complete variable regions (VH and VL) fused onto constant domains (e.g., the constant domains of IgG1/κ), or only the complementarity determining regions (CDRs) grafted onto appropriate framework regions in the variable regions. Antigen binding sites may be wild-type or modified by one or more amino acid substitutions, e.g. modified to resemble human immunoglobulins more closely. Some forms of humanized antibodies preserve all CDR sequences (for example a humanized mouse antibody which contains all six CDRs from the mouse antibody). Other forms have one or more CDRs which are altered with respect to the original antibody.

The term "chimeric antibody" refers to those antibodies wherein one portion of each of the amino acid sequences of heavy and light chains is homologous to corresponding sequences in antibodies derived from a particular species or belonging to a particular class, while the remaining segment of the chain is homologous to corresponding sequences in another. Typically, the variable region of both light and heavy chains mimics the variable regions of antibodies derived from one species of mammals, while the constant portions are homologous to sequences of antibodies derived from another. One clear advantage to such chimeric forms is that the variable region can conveniently be derived from presently known sources using readily available B-cells or hybridomas from non-human host organisms in combination with constant regions derived from, for example, human cell preparations. While the variable region has the advantage of ease of preparation and the specificity is not affected by the source, the constant region being human, is less likely to elicit an immune response from a human subject when the antibodies are injected than would the constant region from a non human source. However, the definition is not limited to this particular example.

The antibodies described herein are preferably isolated. The term "isolated antibody", as used herein, is intended to refer to an antibody which is substantially free of other antibodies having different antigenic specificities. An isolated antibody that specifically binds to an epitope, isoform or variant of a given receptor of the TNF superfamily may, however, have cross-reactivity to other related antigens, e.g., from other species (e.g., species homologs of said receptor). Moreover, an isolated antibody may be substantially free of other cellular material and/or chemicals.

The term "antibody fragment" refers to one or more fragments of an antibody that retain the ability to specifically bind to an antigen and may also be referred to as "antigen-binding fragment" of an antibody. It has been shown that the antigen-binding function of an antibody can be performed by fragments of a full-length antibody. Examples of binding fragments encompassed within the term "antibody fragment" include (i) Fab fragments, monovalent fragments consisting of the VL, VH, CL and CH regions; (ii) F(ab')$_2$ fragments, bivalent fragments comprising two Fab fragments linked by a disulfide bridge at the hinge region; (iii) Fd fragments consisting of the VH and CH regions; (iv) Fv fragments consisting of the VL and VH regions of a single arm of an antibody, (v) dAb fragments (Ward et al., (1989) Nature 341: 544-546), which consist of a VH region; (vi) isolated complementarity determining regions (CDR), and (vii) combinations of two or more isolated CDRs which may optionally be joined by a synthetic linker. Furthermore, although the two regions/domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFV); see, e.g., Bird et al. (1988) Science 242: 423-426; and Huston et al. (1988) Proc. Natl. Acad. Sci. USA 85: 5879-5883). Such single chain antibodies are also intended to be encompassed within the term "antibody fragment". A further example is a binding-domain immunoglobulin fusion protein comprising (i) a binding domain polypeptide that is fused to an immunoglobulin hinge region polypeptide, (ii) an immunoglobulin heavy chain CH2 constant region fused to the hinge region, and (iii) an immunoglobulin heavy chain CH3 constant region fused to the CH2 constant region. The binding domain polypeptide can be a heavy chain variable region or a light chain variable region. The binding-domain immunoglobulin fusion proteins are further disclosed in US 2003/0118592 and US 2003/0133939. These antibody fragments are obtained using conventional techniques known to those with skill in the art, and the fragments are screened for utility in the same manner as are intact antibodies.

The terms "part" or "fragment" are used interchangeably herein and refer to a continuous element. For example, a part of a structure such as an amino acid sequence or protein refers to a continuous element of said structure. A portion, a part or a fragment of a structure preferably comprises one or more functional properties of said structure. For example, a portion, a part or a fragment of an epitope or peptide is preferably immunologically equivalent to the epitope or peptide it is derived from. A part or fragment of a protein sequence preferably comprises a sequence of at least 6, in particular at least 8, at least 12, at least 15, at least 20, at least 30, at least 50, or at least 100 consecutive amino acids of the protein sequence.

When used in connection with VH and VL domains, the term "fragment" preferably refers to one or more of the complementarity-determining regions (CDRs), preferably at least the CDR3 variable region, of the heavy chain variable region (VH) and/or of the light chain variable region (VL). In one embodiment, said one or more of the complementarity-determining regions (CDRs) are selected from a set of complementarity-determining regions CDR1, CDR2 and CDR3. In a particularly preferred embodiment, the term "fragment" refers to the complementarity-determining regions CDR1, CDR2 and CDR3 of the heavy chain variable region (VH), i.e. HCDR1, HCDR2 and HCDR3, and/or of the light chain variable region (VL), i.e. LCDR1, LCDR2 and LCDR3.

The teaching given herein with respect to specific amino acid sequences, e.g., those shown in the sequence listing, is to be construed so as to also relate to variants of said specific sequences resulting in sequences which are functionally equivalent to said specific sequences, e.g., amino acid sequences exhibiting properties identical or similar to those of the specific amino acid sequences. One important property is to retain binding to a target.

For example, the sequences shown in the sequence listing can be modified so as to remove one or more, preferably all free cysteine residues, in particular by replacing the cysteine residues by amino acids other than cysteine, preferably serine, alanine, threonine, glycine, tyrosine, leucine or methionine, most preferably alanine or serine.

It will be appreciated by those skilled in the art that, in particular, the sequences of the CDRs and variable regions can be modified without losing the ability to bind the first and/or the second receptor of the TNF superfamily. For example, CDR regions will be either identical or highly homologous to the regions of antibodies specified herein. By "highly homologous" it is contemplated that from 1 to 5, preferably from 1 to 4, such as 1 to 3 or 1 or 2 substitutions may be made in the CDRs. In addition, the hypervariable and variable regions may be modified so that they show substantial homology with the regions of antibodies specifically disclosed herein.

For the purposes of the present invention, "variants" of an amino acid sequence, in particular variants of a heavy chain variable domain (VH) or of a light chain variable domain (VL), comprise amino acid insertion variants, amino acid addition variants, amino acid deletion variants and/or amino acid substitution variants. Amino acid deletion variants that comprise the deletion at the N-terminal and/or C-terminal end of the protein are also called N-terminal and/or C-terminal truncation variants.

Amino acid insertion variants comprise insertions of single or two or more amino acids in a particular amino acid sequence. In the case of amino acid sequence variants having an insertion, one or more amino acid residues are inserted into a particular site in an amino acid sequence, although random insertion with appropriate screening of the resulting product is also possible.

Amino acid addition variants comprise amino- and/or carboxy-terminal fusions of one or more amino acids, such as 1, 2, 3, 5, 10, 20, 30, 50, or more amino acids.

Amino acid deletion variants are characterized by the removal of one or more amino acids from the sequence, such as by removal of 1, 2, 3, 5, 10, 20, 30, 50, or more amino acids. The deletions may be in any position of the protein.

Amino acid substitution variants are characterized by at least one residue in the sequence being removed and another residue being inserted in its place. Preference is given to modifications being in positions in the amino acid sequence which are not conserved between homologous proteins or peptides and/or to replacing amino acids with other ones having similar properties. Preferably, amino acid substitutions in protein variants are conservative amino acid substitutions. A conservative amino acid substitution involves substitution of an amino acid with another one of the same family of amino acids, i.e., amino acids which are related in their side chains (e.g., in terms of the electrical charge and/or size). Naturally occurring amino acids are generally divided into four families: acidic (aspartate, glutamate), basic (lysine, arginine, histidine), non-polar (alanine, valine, leucine, isoleucine, proline, phenylalanine, methionine, tryptophan), and uncharged polar (glycine, asparagine, glutamine, cysteine, serine, threonine, tyrosine) amino acids. Phenylalanine, tryptophan, and tyrosine are sometimes classified jointly as aromatic amino acids.

Preferably the degree of similarity, preferably identity between a given amino acid sequence and an amino acid sequence which is a variant of said given amino acid sequence will be at least about 60%, 65%, 70%, 80%, 81%, 82%, 83%, 84%, 85%, 86%, 87%, 88%, 89%, 90%, 91%, 92%, 93%, 94%, 95%, 96%, 97%, 98%, or 99%. The degree of similarity or identity is given preferably for an amino acid region which is at least about 10%, at least about 20%, at least about 30%, at least about 40%, at least about 50%, at least about 60%, at least about 70%, at least about 80%, at least about 90% or about 100% of the entire length of the reference amino acid sequence. For example, if the reference amino acid sequence consists of 200 amino acids, the degree of similarity or identity is given preferably for at least about 20, at least about 40, at least about 60, at least about 80, at least about 100, at least about 120, at least about 140, at least about 160, at least about 180, or about 200 amino acids, preferably continuous amino acids. In preferred embodiments, the degree of similarity or identity is given for the entire length of the reference amino acid sequence. The alignment for determining sequence similarity, preferably sequence identity can be done with art known tools, preferably using the best sequence alignment, for example, using Align, using standard settings, preferably EMBOSS::needle, Matrix: Blosum62, Gap Open 10.0, Gap Extend 0.5.

"Sequence similarity" indicates the percentage of amino acids that either are identical or that represent conservative amino acid substitutions. "Sequence identity" between two amino acid sequences indicates the percentage of amino acids that are identical between the sequences.

The term "percentage identity" is intended to denote a percentage of amino acid residues which are identical between the two sequences to be compared, obtained after the best alignment, this percentage being purely statistical and the differences between the two sequences being distributed randomly and over their entire length. Sequence comparisons between two amino acid sequences are conventionally carried out by comparing these sequences after having aligned them optimally, said comparison being carried out by segment or by "window of comparison" in order to identify and compare local regions of sequence similarity. The optimal alignment of the sequences for comparison may be produced, besides manually, by means of the local homology algorithm of Smith and Waterman, 1981, Ads App. Math. 2, 482, by means of the local homology algorithm of Neddleman and Wunsch, 1970, J. Mol. Biol. 48, 443, by means of the similarity search method of Pearson and Lipman, 1988, Proc. Natl Acad. Sci. USA 85, 2444, or by means of computer programs which use these algorithms (GAP, BESTFIT, PASTA, BLAST P, BLAST N and TFASTA in Wisconsin Genetics Software Package, Genetics Computer Group, 575 Science Drive, Madison, Wis.).

The percentage identity is calculated by determining the number of identical positions between the two sequences being compared, dividing this number by the number of positions compared and multiplying the result obtained by 100 so as to obtain the percentage identity between these two sequences.

Binding agents in accordance with the present invention may be at least bispecific or multispecific, such as trispecific, tetraspecific and so on.

The term "bispecific molecule" refers to a molecule that has two different binding specificities and thus may bind to two different types of antigen, such as a first and a second receptor of the TNF superfamily. Such bispecific molecule may be in the format of an antibody molecule or of an antibody-like molecule or of a protein scaffold with antibody-like properties or of a cyclic peptide with at least two binding specificities.

The term "bispecific antibody", as used herein, refers to an antibody comprising two antigen-binding sites, a first binding site having affinity for a first antigen or epitope and a second binding site having binding affinity for a second antigen or epitope distinct from the first. In particular, a bispecific antibody is an artificial protein that is composed of fragments of two different antibodies (said fragments of two different antibodies forming two binding domains) and consequently binds to two different types of antigen.

A bispecific molecule/antibody according to the invention is engineered to simultaneously bind to a first receptor of the TNF superfamily and to a second receptor of the TNF superfamily, wherein the first receptor and the second receptor are different and may be located on the same cell ("cis") or different cells ("trans").

In one embodiment, the first receptor and the second receptor are located on the same cell and are selected from the group consisting of CD27, OX40 (CD134) and 4-1BB (CD137). In one embodiment; said cell is a T cell.

In another embodiment, the first receptor and the second receptor are located on different cells, wherein the first receptor is CD40 and the second receptor is selected from the group consisting of CD27, OX40 (CD134) and 4-1BB (CD137). In one embodiment, said different cells are an antigen-presenting cell (APC), such as a dendritic cell, expressing CD40 and a T cell expressing the second receptor selected from the group consisting of CD27, OX40 (CD134) and 4-1BB (CD137).

Bispecific (full-length) antibodies may be obtained by covalently/chemically linking two (monoclonal) antibodies or by conventional hybrid-hybridoma techniques. Covalent linking of two monoclonal antibodies is described, for example, in Anderson (1992), Blood 80:2826-34. In the context of this invention, one of the antibodies is specific for the first receptor of the TNF superfamily and the other one for the second receptor of the TNF superfamily.

Alternatively, bispecific (full-length) antibodies may be obtained by using the knobs-into-holes technology, which allows the hetero-dimerization of antibody heavy chains by introducing specific mutations in the CH3 dimer interface, e.g., in the CH3 dimer interface of IgG1 or IgG4. This technology is described, for example, in Spiess C. et al. (2013), Journal of Biological Chemistry 288(37):26583-93; Labrijn A. F. et al. (2013), PNAS 110(13):5145-50; and WO 2008/119353 A1.

In one embodiment, the bispecific antibody is a bispecific single-chain antibody.

As used herein, a "bispecific single-chain antibody" denotes a single polypeptide chain comprising two binding domains. Each binding domain comprises one VH region, wherein the VH region of the first binding domain specifically binds to the first receptor of the TNF superfamily (REC1), and the VH region of the second binding domain specifically binds to the second receptor of the TNF superfamily (REC2). The two binding domains are optionally linked to one another by a short peptide linker. Each binding domain may additionally comprise one variable region from an antibody light chain (VL), the VH region and VL region within each of the first and second binding domains being linked to one another via a long peptide linker, which is long enough to allow the VH region and VL region of the first binding domain and the VH region and VL region of the second binding domain to pair with one another.

In one embodiment, the corresponding variable heavy chain regions (VH) and the corresponding variable light chain regions (VL) are arranged, from N-terminus to C-terminus, in the order VH(REC1)-VL(REC1)-VH(REC2)-VL(REC2), VH(REC2)-VL(REC2)-VH(REC1)-VL(REC1) or VH(REC2)-VL(REC2)-VL(REC1)-VH(REC1). It is, however, also envisaged that the bispecific single chain antibodies of the invention comprise other domain arrangements, such as VL(REC1)-VH(REC1)-VH(REC2)-VL(REC2), VL(REC1)-VH(REC1)-VL(REC2)-VH(REC2), VH(REC1)-VL(REC1)-VL(REC2)-VH(REC2), VL(REC2)-VH(REC2)-VH(REC1)-VL(REC1), VL(REC2)-VH(REC2)-VL(REC1)-VH(REC1).

Peptide linkers are generally designed to provide flexibility and protease resistance. In one embodiment, the peptide linker is a glycine-serine-threonine-rich linker or glycine-serine-rich linker, wherein at least 50%, preferably at least 60%, more preferably at least 70%, more preferably at least 80%, even more preferably at least 90% of the amino acids are a glycine or serine or threonine residue or a glycine or serine residue, respectively. In another embodiment, the amino acids are selected from glycine, serine and threonine, i.e., the peptide linker is exclusively composed of glycine, serine and threonine residues (referred to as a glycine-serine-threonine linker). In yet another embodiment, the peptide linker is exclusively composed of glycine and serine residues (referred to as a glycine-serine linker). Short peptide linkers may consist of 12 or less such as 11, 10, 9, 8, 7, 6, 5, 4, 3 or 2 amino acids, and preferably, 5 or 6 amino acids. Short peptide linkers preferably comprise the amino acid sequences SGGGGS or GGGGS. Long peptide linkers may consist of 12 or more, such as 15 to 25 or 15 to 20 or 15 to 18 amino acids, and may, for example, be selected from $(GGGGS)_3$, $(GGGGS)_4$ and $(GGGGS)_5$. In one embodiment, the binding agent of the invention is in the format of a bispecific antibody fragment.

The binding agent according to the invention may be one of various types of bivalent and trivalent single-chain variable fragments (scFvs), fusion proteins mimicking the variable domains of two antibodies. A single-chain variable fragment (scFv) is a fusion protein of the variable regions of the heavy (VH) and light chains (VL) of immunoglobulins, connected with a peptide linker of ten to about 25 amino acids. The peptide linker is usually rich in glycine for flexibility, as well as serine or threonine for solubility, and can either connect the N-terminus of the VH with the C-terminus of the VL, or vice versa. Divalent (or bivalent) single-chain variable fragments (di-scFvs, bi-scFvs) can be engineered by linking two scFvs. This can be done by producing a single peptide chain with two VH and two VL regions, yielding tandem scFvs. The invention also includes multispecific molecules comprising more than two scFvs binding domains. This makes it possible that the molecule comprises either multiple antigen specificities and is a trispecific, tetraspecific, or multispecific molecule, or the molecule is a bispecific molecule comprising more than one scFv binding domain with specificity for the same antigen. In particular, the molecule of the invention may be a multispecific single chain Fv.

In one embodiment, the binding agent comprises two Fab regions, one being directed against the first receptor of the TNF superfamily and the other being directed against the second receptor of the TNF superfamily. In one embodiment, the binding agent is an antigen-binding fragment (Fab)2 complex. The (Fab)2 complex is composed of two Fab fragments, one Fab fragment comprising a Fv domain, i.e. VH and VL domains, binding to the first receptor of the TNF superfamily, and the other Fab fragment comprising a Fv domain binding to the second receptor of the TNF superfamily. Each of the Fab fragments may be composed of two single chains, a VL-CL module and a VH-CH module. Alternatively, each of the individual Fab fragments may be arranged in a single chain, preferably, VL-CL-CH-VH, and the individual variable and constant domains may be connected with a peptide linker. In general, the individual single chains and Fab fragments may be connected via disulfide bonds, adhesive domains, chemical linkage and/or peptide linker(s). The binding agent may also comprise more than two Fab fragments, in particular, the molecule may be a Fab3, Fab4, or a multimeric Fab complex with specificity for 2, 3, 4, or more different antigens. The invention also includes chemically linked Fabs.

Another possibility is the creation of scFvs with peptide linkers that are too short for the two variable regions to fold together (about five amino acids), forcing scFvs to dimerize. This type is known as diabodies. Still shorter peptide linkers (one or two amino acids) lead to the formation of trimers, so-called triabodies or tribodies. Tetrabodies have also been produced. They exhibit an even higher affinity to their targets than diabodies.

A diabody (Kipriyanov, Int. J. Cancer 77 (1998), 763-772) is a small bivalent and bispecific antibody fragment. Diabodies comprise a heavy chain variable domain (VH) connected to a light chain variable domain (VL) on the same polypeptide chain (VH-VL) connected by a peptide linker that is too short to allow pairing between the two domains on the same chain. This forces pairing with the complementary domains of another chain and promotes the assembly of a dimeric molecule with two functional antigen-binding sites. To construct bispecific diabodies of the invention, the V-domains of an antibody binding to the first receptor of the TNF superfamily (REC1) and an antibody binding to the second receptor of the TNF superfamily (REC2) may be fused to create the two chains VH(REC1)-VL(REC2) and VH(REC2)-VL(REC1). Each chain by itself is not able to bind to the respective antigen, but recreates the functional antigen binding sites of an anti-REC1 antibody and an anti-REC2 antibody on pairing with the other chain. To this end, a peptide linker that is too short to allow pairing between the two domains on the same chain is used. The two scFv molecules, with a linker between heavy chain variable domain and light chain variable domain that is too short for intramolecular dimerization, are co-expressed and self assemble to form bi-specific molecules with the two binding sites at opposite ends.

In one embodiment, the bispecific antibody fragment binding to the first receptor of the TNF superfamily (REC1) and the second receptor of the TNF superfamily (REC2) is a minibody, preferably, a minibody comprising two single VH-VL-C chains that are connected with each other via the constant domain (C) of each chain. According to this aspect, the corresponding variable heavy chain regions (VH), corresponding variable light chain regions (VL) and constant domains (C) are arranged, from N-terminus to C-terminus, in the order VH(REC1)-VL(REC1)-(C) and VH(REC2)-VL(REC2)-C, wherein C is preferably a CH3 domain. Pairing of the constant domains results in formation of the minibody.

In one embodiment, the bispecific binding agent is in the format of an antibody-like molecule with a heavy chain containing two consecutive N-terminal variable domains with different specificities and a light chain with two consecutive variable domains with different specificities resulting in four binding domains with two different specificities (Wu et al. (2007), Nat. Biotechnology 25(11))

Binding agents according to the invention may also comprises an amino acid sequence for facilitating secretion of the molecule, such as a N-terminal secretion signal, and/or one or more labels or tags facilitating binding, purification or detection of the molecule.

Preferably, the secretion signal is a signal sequence that allows a sufficient passage through the secretory pathway and/or secretion of the binding agent into the extracellular environment. Preferably, the secretion signal sequence is cleavable and is removed from the mature binding agent. The secretion signal sequence preferably is chosen with respect to the cell or organism wherein the binding agent is produced in.

A "label or tag facilitating binding, purification or detection of the molecule" is meant to include any labels/tags known in the art for these purposes. Particularly preferred are affinity tags, such as chitin binding protein (CBP), maltose binding protein (MBP), glutathione-S-transferase (GST) and poly(His) (e.g., His6); solubilization tags, such as thioredoxin (TRX) and poly(NANP); chromatography tags, such as a FLAG-tag; epitope tags, such as V5-tag, myc-tag and HA-tag; and fluorescent or luminescent labels or tags, such as fluorescent proteins (e.g., GFP, YFP, RFP etc.), fluorescent dyes and luciferase.

The amino acid sequence of a (poly)peptide label or tag may be introduced at any position within the amino acid sequence of the binding agent, and may, for example, take the shape of a loop within the encoded protein structure or it may be N-terminally or C-terminally fused. The label or tag may further contain a cleavage site that allows a removal of the label or tag from the binding agent. Similarly, non-peptidic labels or tags, e.g., fluorescent dyes, may be conjugated to the binding agent at any suitable site.

Binding agents of the invention may contain, e.g., in addition to said first and second binding domain, a further binding domain which serves e.g. to enhance selectivity for a specific cell type. This can be achieved, e.g., by providing a binding domain that binds to another antigen expressed on said specific cell type.

Binding agents of the invention may further comprise one or more modifications increasing the stability of the binding agent. The term "stability" of the binding agent relates to the "half-life" of the binding agent, e.g., in vivo. "Half-life" relates to the period of time which is needed to eliminate half of the activity, amount, or number of molecules.

The binding agent may, for example, be conjugated to a half-life extension module. Such modules are known to a person skilled in the art and include, for example, albumin, an albumin-binding domain, an immunoglobulin-binding domain, an FcRn-binding motif, and, in particular, a polymer. Particularly preferred polymers include polyethylene glycol (PEG), hydroxyethyl starch (HES), polysialic acid and PEG-mimetic peptide sequences.

The binding agents described herein may be conjugated to a therapeutic moiety or agent, such as a cytotoxin, a drug (e.g., an immunosuppressant) or a radioisotope. A cytotoxin or cytotoxic agent includes any agent that is detrimental to and, in particular, kills cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Suitable therapeutic agents for forming conjugates include, but are not limited to, antimetabolites (e.g., methotrexate, 6-mercaptopurine, 6-thioguanine, cytarabine, fludarabin, 5-fluorouracil decarbazine), alkylating agents (e.g., mechlorethamine, thioepa chlorambucil, melphalan, carmustine (BSNU) and lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC), and anti-mitotic agents (e.g., vincristine and vinblastine). In a preferred embodiment, the therapeutic agent is a cytotoxic agent or a radiotoxic agent. In another embodiment, the therapeutic agent is an immunosuppressant. In yet another embodiment, the therapeutic agent is GM-CSF. In a preferred embodiment, the therapeutic agent is doxorubicin, cisplatin, bleomycin, sulfate, carmustine, chlorambucil, cyclophosphamide or ricin A.

Binding agents also can be conjugated to a radioisotope, e.g., iodine-131, yttrium-90 or indium-111, to generate cytotoxic radiopharmaceutical.

Techniques for conjugating such therapeutic moiety to binding agents, such as antibodies or fragments thereof, are well known, see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62: 119-58 (1982).

The present invention provides a binding agent comprising at least two binding domains, wherein a first binding domain binds to a first receptor of the tumor necrosis factor (TNF) superfamily and a second binding domain binds to a second receptor of the TNF superfamily, wherein the first receptor and the second receptor are different.

In one embodiment, the first binding domain binds to CD40 and the second binding domain binds to CD27, wherein, preferably, the binding agent comprises one or more CDRs or one or more variable domains of antibody AB40_1, and one or more CDRs or one or more variable domains of an antibody AB27_X, wherein X is selected from the group consisting of 1 to 186, as shown in Table 7.

"AB40_1" refers to an antibody binding to CD40, which comprises (a) heavy chain complementarity determining regions HCDR1 having the amino acid sequence of SEQ ID NO: 2323, HCDR2 having the amino acid sequence of SEQ ID NO: 2324 and HCDR3 having the amino acid sequence of SEQ ID NO: 2325, and light chain complementarity determining regions LCDR1 having the amino acid sequence of SEQ ID NO: 2326, LCDR2 having the amino acid sequence of SEQ ID NO: 2327 and LCDR3 having the amino acid sequence of SEQ ID NO: 2328; and (b) heavy chain variable domain (VH) having the amino acid sequence of SEQ ID NO: 2321 and light chain variable domain (VL) having the amino acid sequence of SEQ ID NO: 2322.

In various embodiments, the binding agent comprises one or more CDRs or one or more variable domains of antibody AB40_1 and X is 1; the binding agent comprises one or more CDRs or one or more variable domains of antibody AB40_1 and X is 2; the binding agent comprises one or more CDRs or one or more variable domains of antibody AB40_1 and X is 3; the binding agent comprises one or more CDRs or one or more variable domains of antibody AB40_1 and X is 4; the binding agent comprises one or more CDRs or one or more variable domains of antibody AB40_1 and X is 5; the binding agent comprises one or more CDRs or one or more variable domains of antibody AB40_1 and X is 6; the binding agent comprises one or more CDRs or one or more variable domains of antibody AB40_1 and X is 7; the binding agent comprises one or more CDRs or one or more variable domains of antibody AB40_1 and X is 8; the binding agent comprises one or more CDRs or one or more variable domains of antibody AB40_1 and X is 9; the binding agent comprises one or more CDRs or one or more variable domains of antibody AB40_1 and X is 10; the binding agent comprises one or more CDRs or one or more variable domains of antibody AB40_1 and X is 11; the binding agent comprises one or more CDRs or one or more variable domains of antibody AB40_1 and X is 12; the binding agent comprises one or more CDRs or one or more variable domains of antibody AB40_1 and X is 13; the binding agent comprises one or more CDRs or one or more variable domains of antibody AB40_1 and X is 14; the binding agent comprises one or more CDRs or one or more variable domains of antibody AB40_1 and X is 15; the binding agent comprises one or more CDRs or one or more variable domains of antibody AB40_1 and X is 16; the binding agent comprises one or more CDRs or one or more variable domains of antibody AB40_1 and X is 17; the binding agent comprises one or more CDRs or one or more variable domains of antibody AB40_1 and X is 18; the binding agent comprises one or more CDRs or one or more variable domains of antibody AB40_1 and X is 19; the binding agent comprises one or more CDRs or one or more variable domains of antibody AB40_1 and X is 20; the binding agent comprises one or more CDRs or one or more variable domains of antibody AB40_1 and X is 21; the binding agent comprises one or more CDRs or one or more variable domains of antibody AB40_1 and X is 22; the binding agent comprises one or more CDRs or one or more variable domains of antibody AB40_1 and X is 23; the binding agent comprises one or more CDRs or one or more variable domains of antibody AB40_1 and X is 24; the binding agent comprises one or more CDRs or one or more variable domains of antibody AB40_1 and X is 25; the binding agent comprises one or more CDRs or one or more variable domains of antibody AB40_1 and X is 26; the binding agent comprises one or more CDRs or one or more variable domains of antibody AB40_1 and X is 27; the binding agent comprises one or more CDRs or one or more variable domains of antibody AB40_1 and X is 28; the binding agent comprises one or more CDRs or one or more variable domains of antibody AB40_1 and X is 29; the binding agent comprises one or more CDRs or one or more variable domains of antibody AB40_1 and X is 30; the binding agent comprises one or more CDRs or one or more variable domains of antibody AB40_1 and X is 31; the binding agent comprises one or more CDRs or one or more variable domains of antibody AB40_1 and X is 32; the binding agent comprises one or more CDRs or one or more variable domains of antibody AB40_1 and X is 33; the binding agent comprises one or more CDRs or one or more variable domains of antibody AB40_1 and X is 34; the binding agent comprises one or more CDRs or one or more variable domains of antibody AB40_1 and X is 35; the binding agent comprises one or more CDRs or one or more variable domains of antibody AB40_1 and X is 36; the binding agent comprises one or more CDRs or one or more variable domains of antibody AB40_1 and X is 37; the binding agent comprises one or more CDRs or one or more variable domains of antibody AB40_1 and X is 38; the binding agent comprises one or more CDRs or one or more variable domains of antibody AB40_1 and X is 39; the binding agent comprises one or more CDRs or one or more variable domains of antibody AB40_1 and X is 40; the binding agent comprises one or more CDRs or one or more variable domains of antibody AB40_1 and X is 41; the binding agent comprises one or more CDRs or one or more variable domains of antibody AB40_1 and X is 42; the binding agent comprises one or more CDRs or one or more variable domains of antibody AB40_1 and X is 43; the binding agent comprises one or more CDRs or one or more variable domains of antibody AB40_1 and X is 44; the binding agent comprises one or more CDRs or one or more variable domains of antibody AB40_1 and X is 45; the binding agent comprises one or more CDRs or one or more variable domains of antibody AB40_1 and X is 46; the binding agent comprises one or more CDRs or one or more variable domains of antibody AB40_1 and X is 47; the binding agent comprises one or more CDRs or one or more variable domains of antibody AB40_1 and X is 48; the binding agent comprises one or more CDRs or one or more variable domains of antibody AB40_1 and X is 49; the binding agent comprises one or more CDRs or one or more variable domains of antibody AB40_1 and X is 50; the binding agent comprises one or more CDRs or one or more variable domains of antibody AB40_1 and X is 51; the binding agent comprises one or more CDRs or one or more variable domains of antibody AB40_1 and X is 52; the binding agent comprises one or more CDRs or one or more variable domains of antibody AB40_1 and X is 53; the binding agent comprises one or more CDRs or one or more variable domains of antibody AB40_1 and X is 54; the binding agent comprises one or more CDRs or one or more variable domains of antibody AB40_1 and X is 55; the binding agent comprises one or more CDRs or one or more variable domains of antibody AB40_1 and X is 56; the binding agent comprises one or more CDRs or one or more variable domains of antibody AB40_1 and X is 57; the binding agent comprises one or more CDRs or one or more variable domains of antibody AB40_1 and X is 58; the binding agent comprises one or more CDRs or one or more variable domains of antibody AB40_1 and X is 59; the binding agent comprises one or more CDRs or one or more variable domains of antibody AB40_1 and X is 60; the binding agent comprises one or more CDRs or one or more variable domains of antibody AB40_1 and X is 61; the binding agent comprises one or more CDRs or one or more variable domains of antibody AB40_1 and X is 62; the binding agent comprises one or more CDRs or one or more variable domains of antibody AB40_1 and X is 63; the binding agent comprises one or more CDRs or one or more variable domains of antibody AB40_1 and X is 64; the binding agent comprises one or more CDRs or one or more variable domains of antibody AB40_1 and X is 65; the binding agent comprises one or more CDRs or one or more variable domains of antibody AB40_1 and X is 66; the binding agent comprises one or more CDRs or one or more variable domains of antibody AB40_1 and X is 67; the binding agent comprises one or more CDRs or one or more variable domains of antibody AB40_1 and X is 68; the binding agent comprises one or more CDRs or one or more variable domains of antibody AB40_1 and X is 69; the binding agent comprises one or more CDRs or one or more variable domains of antibody AB40_1 and X is 70; the binding agent comprises one or more CDRs or one or more variable domains of antibody AB40_1 and X is 71; the binding agent comprises one or more CDRs or one or more variable domains of antibody AB40_1 and X is 72; the binding agent comprises one or more CDRs or one or more variable domains of antibody AB40_1 and X is 73; the binding agent comprises one or more CDRs or one or more variable domains of antibody AB40_1 and X is 74; the binding agent comprises one or more CDRs or one or more variable domains of antibody AB40_1 and X is 75; the binding agent comprises one or more CDRs or one or more variable domains of antibody AB40_1 and X is 76; the binding agent comprises one or more CDRs or one or more variable domains of antibody AB40_1 and X is 77; the binding agent comprises one or more CDRs or one or more variable domains of antibody AB40_1 and X is 78; the binding agent comprises one or more CDRs or one or more variable domains of antibody AB40_1 and X is 79; the binding agent comprises one or more CDRs or one or more variable domains of antibody AB40_1 and X is 80; the binding agent comprises one or more CDRs or one or more variable domains of antibody AB40_1 and X is 81; the binding agent comprises one or more CDRs or one or more variable domains of antibody AB40_1 and X is 82; the binding agent comprises one or more CDRs or one or more variable domains of antibody AB40_1 and X is 83; the binding agent comprises one or more CDRs or one or more variable domains of antibody AB40_1 and X is 84; the binding agent comprises one or more CDRs or one or more variable domains of antibody AB40_1 and X is 85; the binding agent comprises one or more CDRs or one or more variable domains of antibody AB40_1 and X is 86; the binding agent comprises one or more CDRs or one or more variable domains of antibody AB40_1 and X is 87; the binding agent comprises one or more CDRs or one or more variable domains of antibody AB40_1 and X is 88; the binding agent comprises one or more CDRs or one or more variable domains of antibody AB40_1 and X is 89; the binding agent comprises one or more CDRs or one or more variable domains of antibody AB40_1 and X is 90; the binding agent comprises one or more CDRs or one or more variable domains of antibody AB40_1 and X is 91; the binding agent comprises one or more CDRs or one or more variable domains of antibody AB40_1 and X is 92; the binding agent comprises one or more CDRs or one or more variable domains of antibody AB40_1 and X is 93; the binding agent comprises one or more CDRs or one or more variable domains of antibody AB40_1 and X is 94; the binding agent comprises one or more CDRs or one or more variable domains of antibody AB40_1 and X is 95; the binding agent comprises one or more CDRs or one or more variable domains of antibody AB40_1 and X is 96; the binding agent comprises one or more CDRs or one or more variable domains of antibody AB40_1 and X is 97; the binding agent comprises one or more CDRs or one or more variable domains of antibody AB40_1 and X is 98; the binding agent comprises one or more CDR3 or one or more variable domains of antibody AB40_1 and X is 99; the binding agent comprises one or more CDRs or one or more variable domains of antibody AB40_1 and X is 100; the binding agent comprises one or more CDRs or one or more variable domains of antibody AB40_1 and X is 101; the binding agent comprises one or more CDRs or one or more variable domains of antibody AB40_1 and X is 102; the binding agent comprises one or more CDRs or one or more variable domains of antibody AB40_1 and X is 103; the binding agent comprises one or more CDRs or one or more variable domains of antibody AB40_1 and X is 104; the binding agent comprises one or more CDRs or one or more variable domains of antibody AB40_1 and X is 105; the binding agent comprises one or more CDRs or one or more variable domains of antibody AB40_1 and X is 106; the binding agent comprises one or more CDRs or one or more variable domains of antibody AB40_1 and X is 107; the binding agent comprises one or more CDRs or one or more variable domains of antibody AB40_1 and X is 108; the binding agent comprises one or more CDRs or one or more variable domains of antibody AB40_1 and X is 109; the binding agent comprises one or more CDRs or one or more variable domains of antibody AB40_1 and X is 110; the binding agent comprises one or more CDRs or one or more variable domains of antibody AB40_1 and X is 111; the binding agent comprises one or more CDRs or one or more variable domains of antibody AB40_1 and X is 112; the binding agent comprises one or more CDRs or one or more variable domains of antibody AB40_1 and X is 113; the binding agent comprises one or more CDRs or one or more variable domains of antibody AB40_1 and X is 114; the binding agent comprises one or more CDRs or one or more variable domains of antibody AB40_1 and X is 115; the binding agent comprises one or more CDRs or one or more variable domains of antibody AB40_1 and X is 116; the binding agent comprises one or more CDRs or one or more variable domains of antibody AB40_1 and X is 117; the binding agent comprises one or more CDRs or one or more variable domains of antibody AB40_1 and X is 118; the binding agent comprises one or more CDRs or one or more variable domains of antibody AB40_1 and X is 119; the binding agent comprises one or more CDRs or one or more variable domains of antibody AB40_1 and X is 120; the binding agent comprises one or more CDRs or one or more variable domains of antibody AB40_1 and X is 121; the binding agent comprises one or more CDRs or one or more variable domains of antibody AB40_1 and X is 122; the binding agent comprises one or more CDRs or one or more variable domains of antibody AB40_1 and X is 123; the binding agent comprises one or more CDRs or one or more variable domains of antibody AB40_1 and X is 124; the binding agent comprises one or more CDRs or one or more variable domains of antibody AB40_1 and X is 125; the binding agent comprises one or more CDRs or one or more variable domains of antibody AB40_1 and X is 126; the binding agent comprises one or more CDRs or one or more variable domains of antibody AB40_1 and X is 127; the binding agent comprises one or more CDRs or one or more variable domains of antibody AB40_1 and X is 128; the binding agent comprises one or more CDRs or one or more variable domains of antibody AB40_1 and X is 129; the binding agent comprises one or more CDRs or one or more variable domains of antibody AB40_1 and X is 130; the binding agent comprises one or more CDRs or one or more variable domains of antibody AB40_1 and X is 131; the binding agent comprises one or more CDRs or one or more variable domains of antibody AB40_1 and X is 132; the binding agent comprises one or more CDRs or one or more variable domains of antibody AB40_1 and X is 133; the binding agent comprises one or more CDRs or one or more variable domains of antibody AB40_1 and X is 134; the binding agent comprises one or more CDRs or one or more variable domains of antibody AB40_1 and X is 135; the binding agent comprises one or more CDRs or one or more variable domains of antibody AB40_1 and X is 136; the binding agent comprises one or more CDRs or one or more variable domains of antibody AB40_1 and X is 137; the binding agent comprises one or more CDRs or one or more variable domains of antibody AB40_1 and X is 138; the binding agent comprises one or more CDRs or one or more variable domains of antibody AB40_1 and X is 139; the binding agent comprises one or more CDRs or one or more variable domains of antibody AB40_1 and X is 140; the binding agent comprises one or more CDRs or one or more variable domains of antibody AB40_1 and X is 141; the binding agent comprises one or more CDRs or one or more variable domains of antibody AB40_1 and X is 142; the binding agent comprises one or more CDRs or one or more variable domains of antibody AB40_1 and X is 143; the binding agent comprises one or more CDRs or one or more variable domains of antibody AB40_1 and X is 144; the binding agent comprises one or more CDRs or one or more variable domains of antibody AB40_1 and X is 145; the binding agent comprises one or more CDRs or one or more variable domains of antibody AB40_1 and X is 146; the binding agent comprises one or more CDRs or one or more variable domains of antibody AB40_1 and X is 147; the binding agent comprises one or more CDRs or one or more variable domains of antibody AB40_1 and X is 148; the binding agent comprises one or more CDRs or one or more variable domains of antibody AB40_1 and X is 149; the binding agent comprises one or more CDRs or one or more variable domains of antibody AB40_1 and X is 150; the binding agent comprises one or more CDRs or one or more variable domains of antibody AB40_1 and X is 151; the binding agent comprises one or more CDRs or one or more variable domains of antibody AB40_1 and X is 152; the binding agent comprises one or more CDRs or one or more variable domains of antibody AB40_1 and X is 153; the binding agent comprises one or more CDRs or one or more variable domains of antibody AB40_1 and X is 154; the binding agent comprises one or more CDRs or one or more variable domains of antibody AB40_1 and X is 155; the binding agent comprises one or more CDRs or one or more variable domains of antibody AB40_1 and X is 156; the binding agent comprises one or more CDRs or one or more variable domains of antibody AB40_1 and X is 157; the binding agent comprises one or more CDRs or one or more variable domains of antibody AB40_1 and X is 158; the binding agent comprises one or more CDRs or one or more variable domains of antibody AB40_1 and X is 159; the binding agent comprises one or more CDRs or one or more variable domains of antibody AB40_1 and X is 160; the binding agent comprises one or more CDRs or one or more variable domains of antibody AB40_1 and X is 161; the binding agent comprises one or more CDRs or one or more variable domains of antibody AB40_1 and X is 162; the binding agent comprises one or more CDRs or one or more variable domains of antibody AB40_1 and X is 163; the binding agent comprises one or more CDRs or one or more variable domains of antibody AB40_1 and X is 164; the binding agent comprises one or more CDRs or one or more variable domains of antibody AB40_1 and X is 165; the binding agent comprises one or more CDRs or one or more variable domains of antibody AB40_1 and X is 166; the binding agent comprises one or more CDRs or one or more variable domains of antibody AB40_1 and X is 167; the binding agent comprises one or more CDRs or one or more variable domains of antibody AB40_1 and X is 168; the binding agent comprises one or more CDRs or one or more variable domains of antibody AB40_1 and X is 169; the binding agent comprises one or more CDRs or one or more variable domains of antibody AB40_1 and X is 170; the binding agent comprises one or more CDRs or one or more variable domains of antibody AB40_1 and X is 171; the binding agent comprises one or more CDRs or one or more variable domains of antibody AB40_1 and X is 172; the binding agent comprises one or more CDRs or one or more variable domains of antibody AB40_1 and X is 173; the binding agent comprises one or more CDRs or one or more variable domains of antibody AB40_1 and X is 174; the binding agent comprises one or more CDRs or one or more variable domains of antibody AB40_1 and X is 175; the binding agent comprises one or more CDRs or one or more variable domains of antibody AB40_1 and X is 176; the binding agent comprises one or more CDRs or one or more variable domains of antibody AB40_1 and X is 177; the binding agent comprises one or more CDRs or one or more variable domains of antibody AB40_1 and X is 178; the binding agent comprises one or more CDRs or one or more variable domains of antibody AB40_1 and X is 179; the binding agent comprises one or more CDRs or one or more variable domains of antibody AB40_1 and X is 180; the binding agent comprises one or more CDRs or one or more variable domains of antibody AB40_1 and X is 181; the binding agent comprises one or more CDRs or one or more variable domains of antibody AB40_1 and X is 182; the binding agent comprises one or more CDRs or one or more variable domains of antibody AB40_1 and X is 183; the binding agent comprises one or more CDRs or one or more variable domains of antibody AB40_1 and X is 184; the binding agent comprises one or more CDRs or one or more variable domains of antibody AB40_1 and X is 185; or the binding agent comprises one or more CDRs or one or more variable domains of antibody AB40_1 and X is 186.

In one embodiment, the binding agent comprises one or more CDRs or one or more variable domains of antibody AB40_1 and X is 5.

In one embodiment, the first binding domain binds to CD40 and the second binding domain binds to OX40 (CD134), wherein, preferably, the binding agent comprises one or more CDRs or one or more variable domains of antibody AB40_1, as defined above, and one or more CDRs or one or more variable domains of an antibody AB134_X, wherein X is selected from the group consisting of 1 to 92, as shown in Table 8.

In various embodiments, the binding agent comprises one or more CDRs or one or more variable domains of antibody AB40_1 and X is 1; the binding agent comprises one or more CDRs or one or more variable domains of antibody AB40_1 and X is 2; the binding agent comprises one or more CDRs or one or more variable domains of antibody AB40_1 and X is 3; the binding agent comprises one or more CDRs or one or more variable domains of antibody AB40_1 and X is 4; the binding agent comprises one or more CDRs or one or more variable domains of antibody AB40_1 and X is 5; the binding agent comprises one or more CDRs or one or more variable domains of antibody AB40_1 and X is 6; the binding agent comprises one or more CDRs or one or more variable domains of antibody AB40_1 and X is 7; the binding agent comprises one or more CDRs or one or more variable domains of antibody AB40_1 and X is 8; the binding agent comprises one or more CDRs or one or more variable domains of antibody AB40_1 and X is 9; the binding agent comprises one or more CDRs or one or more variable domains of antibody AB40_1 and X is 10; the binding agent comprises one or more CDRs or one or more variable domains of antibody AB40_1 and X is 11; the binding agent comprises one or more CDRs or one or more variable domains of antibody AB40_1 and X is 12; the binding agent comprises one or more CDRs or one or more variable domains of antibody AB40_1 and X is 13; the binding agent comprises one or more CDRs or one or more variable domains of antibody AB40_1 and X is 14; the binding agent comprises one or more CDRs or one or more variable domains of antibody AB40_1 and X is 15; the binding agent comprises one or more CDRs or one or more variable domains of antibody AB40_1 and X is 16; the binding agent comprises one or more CDRs or one or more variable domains of antibody AB40_1 and X is 17; the binding agent comprises one or more CDRs or one or more variable domains of antibody AB40_1 and X is 18; the binding agent comprises one or more CDRs or one or more variable domains of antibody AB40_1 and X is 19; the binding agent comprises one or more CDRs or one or more variable domains of antibody AB40_1 and X is 20; the binding agent comprises one or more CDRs or one or more variable domains of antibody AB40_1 and X is 21; the binding agent comprises one or more CDRs or one or more variable domains of antibody AB40_1 and X is 22; the binding agent comprises one or more CDRs or one or more variable domains of antibody AB40_1 and X is 23; the binding agent comprises one or more CDRs or one or more variable domains of antibody AB40_1 and X is 24; the binding agent comprises one or more CDRs or one or more variable domains of antibody AB40_1 and X is 25; the binding agent comprises one or more CDRs or one or more variable domains of antibody AB40_1 and X is 26; the binding agent comprises one or more CDRs or one or more variable domains of antibody AB40_1 and X is 27; the binding agent comprises one or more CDRs or one or more variable domains of antibody AB40_1 and X is 28; the binding agent comprises one or more CDRs or one or more variable domains of antibody AB40_1 and X is 29; the binding agent comprises one or more CDRs or one or more variable domains of antibody AB40_1 and X is 30; the binding agent comprises one or more CDRs or one or more variable domains of antibody AB40_1 and X is 31; the binding agent comprises one or more CDRs or one or more variable domains of antibody AB40_1 and X is 32; the binding agent comprises one or more CDRs or one or more variable domains of antibody AB40_1 and X is 33; the binding agent comprises one or more CDRs or one or more variable domains of antibody AB40_1 and X is 34; the binding agent comprises one or more CDRs or one or more variable domains of antibody AB40_1 and X is 35; the binding agent comprises one or more CDRs or one or more variable domains of antibody AB40_1 and X is 36; the binding agent comprises one or more CDRs or one or more variable domains of antibody AB40_1 and X is 37; the binding agent comprises one or more CDRs or one or more variable domains of antibody AB40_1 and X is 38; the binding agent comprises one or more CDRs or one or more variable domains of antibody AB40_1 and X is 39; the binding agent comprises one or more CDRs or one or more variable domains of antibody AB40_1 and X is 40; the binding agent comprises one or more CDRs or one or more variable domains of antibody AB40_1 and X is 41; the binding agent comprises one or more CDRs or one or more variable domains of antibody AB40_1 and X is 42; the binding agent comprises one or more CDRs or one or more variable domains of antibody AB40_1 and X is 43; the binding agent comprises one or more CDRs or one or more variable domains of antibody AB40_1 and X is 44; the binding agent comprises one or more CDRs or one or more variable domains of antibody AB40_1 and X is 45; the binding agent comprises one or more CDRs or one or more variable domains of antibody AB40_1 and X is 46; the binding agent comprises one or more CDRs or one or more variable domains of antibody AB40_1 and X is 47; the binding agent comprises one or more CDRs or one or more variable domains of antibody AB40_1 and X is 48; the binding agent comprises one or more CDRs or one or more variable domains of antibody AB40_1 and X is 49; the binding agent comprises one or more CDRs or one or more variable domains of antibody AB40_1 and X is 50; the binding agent comprises one or more CDRs or one or more variable domains of antibody AB40_1 and X is 51; the binding agent comprises one or more CDRs or one or more variable domains of antibody AB40_1 and X is 52; the binding agent comprises one or more CDRs or one or more variable domains of antibody AB40_1 and X is 53; the binding agent comprises one or more CDRs or one or more variable domains of antibody AB40_1 and X is 54; the binding agent comprises one or more CDRs or one or more variable domains of antibody AB40_1 and X is 55; the binding agent comprises one or more CDRs or one or more variable domains of antibody AB40_1 and X is 56; the binding agent comprises one or more CDRs or one or more variable domains of antibody AB40_1 and X is 57; the binding agent comprises one or more CDRs or one or more variable domains of antibody AB40_1 and X is 58; the binding agent comprises one or more CDRs or one or more variable domains of antibody AB40_1 and X is 59; the binding agent comprises one or more CDRs or one or more variable domains of antibody AB40_1 and X is 60; the binding agent comprises one or more CDRs or one or more variable domains of antibody AB40_1 and X is 61; the binding agent comprises one or more CDRs or one or more variable domains of antibody AB40_1 and X is 62; the binding agent comprises one or more CDRs or one or more variable domains of antibody AB40_1 and X is 63; the binding agent comprises one or more CDRs or one or more variable domains of antibody AB40_1 and X is 64; the binding agent comprises one or more CDRs or one or more variable domains of antibody AB40_1 and X is 65; the binding agent comprises one or more CDRs or one or more variable domains of antibody AB40_1 and X is 66; the binding agent comprises one or more CDRs or one or more variable domains of antibody AB40_1 and X is 67; the binding agent comprises one or more CDRs or one or more variable domains of antibody AB40_1 and X is 68; the binding agent comprises one or more CDRs or one or more variable domains of antibody AB40_1 and X is 69; the binding agent comprises one or more CDRs or one or more variable domains of antibody AB40_1 and X is 70; the binding agent comprises one or more CDRs or one or more variable domains of antibody AB40_1 and X is 71; the binding agent comprises one or more CDRs or one or more variable domains of antibody AB40_1 and X is 72; the binding agent comprises one or more CDRs or one or more variable domains of antibody AB40_1 and X is 73; the binding agent comprises one or more CDRs or one or more variable domains of antibody and X is 74; the binding agent comprises one or more CDRs or one or more variable domains of antibody AB40_1 and X is 75; the binding agent comprises one or more CDRs or one or more variable domains of antibody AB40_1 and X is 76; the binding agent comprises one or more CDRs or one or more variable domains of antibody AB40_1 and X is 77; the binding agent comprises one or more CDRs or one or more variable domains of antibody AB40_1 and X is 78; the binding agent comprises one or more CDRs or one or more variable domains of antibody AB40_1 and X is 79; the binding agent comprises one or more CDRs or one or more variable domains of antibody AB40_1 and X is 80; the binding agent comprises one or more CDRs or one or more variable domains of antibody AB40_1 and X is 81; the binding agent comprises one or more CDRs or one or more variable domains of antibody AB40_1 and X is 82; the binding agent comprises one or more CDRs or one or more variable domains of antibody AB40_1 and X is 83; the binding agent comprises one or more CDRs or one or more variable domains of antibody AB40_1 and X is 84; the binding agent comprises one or more CDRs or one or more variable domains of antibody AB40_1 and X is 85; the binding agent comprises one or more CDRs or one or more variable domains of antibody AB40_1 and X is 86; the binding agent comprises one or more CDRs or one or more variable domains of antibody AB40_1 and X is 87; the binding agent comprises one or more CDRs or one or more variable domains of antibody AB40_1 and X is 88; the binding agent comprises one or more CDRs or one or more variable domains of antibody AB40_1 and X is 89; the binding agent comprises one or more CDRs or one or more variable domains of antibody AB40_1 and X is 90; the binding agent comprises one or more CDRs or one or more variable domains of antibody AB40_1 and X is 91; or the binding agent comprises one or more CDRs or one or more variable domains of antibody AB40_1 and X is 92.

In one embodiment, the binding agent comprises one or more CDRs or one or more variable domains of antibody AB40_1 and X is 3. In another embodiment, the binding agent comprises one or more CDRs or one or more variable domains of antibody AB40_1 and X is 81.

In one embodiment, the first binding domain binds to CD40 and the second binding domain binds to 4-1BB (CD137), wherein, preferably, the binding agent comprises one or more CDRs or one or more variable domains of antibody AB40_1, as defined above, and one or more CDRs or one or more variable domains of an antibody AB137_X, wherein X is selected from the group consisting of 1 to 12, as shown in Table 9.

In various embodiments, the binding agent comprises one or more CDRs or one or more variable domains of antibody AB40_1 and X is 1; the binding agent comprises one or more CDRs or one or more variable domains of antibody AB40_1 and X is 2; the binding agent comprises one or more CDRs or one or more variable domains of antibody AB40_1 and X is 3; the binding agent comprises one or more CDRs or one or more variable domains of antibody AB40_1 and X is 4; the binding agent comprises one or more CDRs or one or more variable domains of antibody AB40_1 and X is 5; the binding agent comprises one or more CDRs or one or more variable domains of antibody AB40_1 and X is 6; the binding agent comprises one or more CDRs or one or more variable domains of antibody AB40_1 and X is 7; the binding agent comprises one or more CDRs or one or more variable domains of antibody AB40_1 and X is 8; the binding agent comprises one or more CDRs or one or more variable domains of antibody AB40_1 and X is 9; the binding agent comprises one or more CDRs or one or more variable domains of antibody AB40_1 and X is 10; the binding agent comprises one or more CDRs or one or more variable domains of antibody AB40_1 and X is 11; or the binding agent comprises one or more CDRs or one or more variable domains of antibody AB40_1 and X is 12.

In one embodiment, the binding agent comprises one or more CDRs or one or more variable domains of antibody AB40_1 and X is 2. In another embodiment, the binding agent comprises one or more CDRs or one or more variable domains of antibody AB40_1 and X is 12.

In one embodiment, the first binding domain binds to 4-1BB (CD137) and the second binding domain binds to CD27, wherein, preferably, the binding agent comprises one or more CDRs or one or more variable domains of an antibody AB137_X, wherein X is selected from the group consisting of 1 to 12, as shown in Table 9, and one or more CDRs or one or more variable domains of an antibody AB27 Y, wherein Y is selected from the group consisting of 1 to 186, as shown in Table 7.

In various embodiments, X is 1 and Y is selected from the group consisting of 1 to 186; X is 2 and Y is selected from the group consisting of 1 to 186; X is 3 and Y is selected from the group consisting of 1 to 186; X is 4 and Y is selected from the group consisting of 1 to 186; X is 5 and Y is selected from the group consisting of 1 to 186; X is 6 and Y is selected from the group consisting of 1 to 186; X is 7 and Y is selected from the group consisting of 1 to 186; X is 8 and Y is selected from the group consisting of 1 to 186; X is 9 and Y is selected from the group consisting of 1 to 186; X is 10 and Y is selected from the group consisting of 1 to 186; X is 11 and Y is selected from the group consisting of 1 to 186; or X is 12 and Y is selected from the group consisting of 1 to 186.

In various embodiments,
X is 1 and Y is 1; X is 1 and Y is 2; X is 1 and Y is 3; X is 1 and Y is 4; X is 1 and Y is 5; X is 1 and Y is 6; X is 1 and Y is 7; X is 1 and Y is 8; X is 1 and Y is 9; X is 1 and Y is 10; X is 1 and Y is 11; X is 1 and Y is 12; X is 1 and Y is 13; X is 1 and Y is 14; X is 1 and Y is 15; X is 1 and Y is 16; X is 1 and Y is 17; X is 1 and Y is 18; X is 1 and Y is 19; X is 1 and Y is 20; X is 1 and Y is 21; X is 1 and Y is 22; X is 1 and Y is 23; X is 1 and Y is 24; X is 1 and Y is 25; X is 1 and Y is 26; X is 1 and Y is 27; X is 1 and Y is 28; X is 1 and Y is 29; X is 1 and Y is 30; X is 1 and Y is 31; X is 1 and Y is 32; X is 1 and Y is 33; X is 1 and Y is 34; X is 1 and Y is 35; X is 1 and Y is 36; X is 1 and Y is 37; X is 1 and Y is 38; X is 1 and Y is 39; X is 1 and Y is 40; X is 1 and Y is 41; X is 1 and Y is 42; X is 1 and Y is 43; X is 1 and Y is 44; X is 1 and Y is 45; X is 1 and Y is 46; X is 1 and Y is 47; X is 1 and Y is 48; X is 1 and Y is 49; X is 1 and Y is 50; X is 1 and Y is 51; X is 1 and Y is 52; X is 1 and Y is 53; X is 1 and Y is 54; X is 1 and Y is 55; X is 1 and Y is 56; X is 1 and Y is 57; X is 1 and Y is 58; X is 1 and Y is 59; X is 1 and Y is 60; X is 1 and Y is 61; X is 1 and Y is 62; X is 1 and Y is 63; X is 1 and Y is 64; X is 1 and Y is 65; X is 1 and Y is 66; X is 1 and Y is 67; X is 1 and Y is 68; X is 1 and Y is 69; X is 1 and Y is 70; X is 1 and Y is 71; X is 1 and Y is 72; X is 1 and Y is 73; X is 1 and Y is 74; X is 1 and Y is 75; X is 1 and Y is 76; X is 1 and Y is 77; X is 1 and Y is 78; X is 1 and Y is 79; X is 1 and Y is 80; X is 1 and Y is 81; X is 1 and Y is 82; X is 1 and Y is 83; X is 1 and Y is 84; X is 1 and Y is 85; X is 1 and Y is 86; X is 1 and Y is 87; X is 1 and Y is 88; X is 1 and Y is 89; X is 1 and Y is 90; X is 1 and Y is 91; X is 1 and Y is 92; X is 1 and Y is 93; X is 1 and Y is 94; X is 1 and Y is 95; X is 1 and Y is 96; X is 1 and Y is 97; X is 1 and Y is 98; X is 1 and Y is 99; X is 1 and Y is 100; X is 1 and Y is 101; X is 1 and Y is 102; X is 1 and Y is 103; X is 1 and Y is 104; X is 1 and Y is 105; X is 1 and Y is 106; X is 1 and Y is 107; X is 1 and Y is 108; X is 1 and Y is 109; X is 1 and Y is 110; X is 1 and Y is 111; X is 1 and Y is 112; X is 1 and Y is 113; X is 1 and Y is 114; X is 1 and Y is 115; X is 1 and Y is 116; X is 1 and Y is 117; X is 1 and Y is 118; X is 1 and Y is 119; X is 1 and Y is 120; X is 1 and Y is 121; X is 1 and Y is 122; X is 1 and Y is 123; X is 1 and Y is 124; X is 1 and Y is 125; X is 1 and Y is 126; X is 1 and Y is 127; X is 1 and Y is 128; X is 1 and Y is 129; X is 1 and Y is 130; X is 1 and Y is 131; X is 1 and Y is 132; X is 1 and Y is 133; X is 1 and Y is 134; X is 1 and Y is 135; X is 1 and Y is 136; X is 1 and Y is 137; X is 1 and Y is 138; X is 1 and Y is 139; X is 1 and Y is 140; X is 1 and Y is 141; X is 1 and Y is 142; X is 1 and Y is 143; X is 1 and Y is 144; X is 1 and Y is 145; X is 1 and Y is 146; X is 1 and Y is 147; X is 1 and Y is 148; X is 1 and Y is 149; X is 1 and Y is 150; X is 1 and Y is 151; X is 1 and Y is 152; X is 1 and Y is 153; X is 1 and Y is 154; X is 1 and Y is 155; X is 1 and Y is 156; X is 1 and Y is 157; X is 1 and Y is 158; X is 1 and Y is 159; X is 1 and Y is 160; X is 1 and Y is 161; X is 1 and Y is 162; X is 1 and Y is 163; X is 1 and Y is 164; X is 1 and Y is 165; X is 1 and Y is 166; X is 1 and Y is 167; X is 1 and Y is 168; X is 1 and Y is 169; X is 1 and Y is 170; X is 1 and Y is 171; X is 1 and Y is 172; X is 1 and Y is 173; X is 1 and Y is 174; X is 1 and Y is 175; X is 1 and Y is 176; X is 1 and Y is 177; X is 1 and Y is 178; X is 1 and Y is 179; X is 1 and Y is 180; X is 1 and Y is 181; X is 1 and Y is 182; X is 1 and Y is 183; X is 1 and Y is 184; X is 1 and Y is 185; X is 1 and Y is 186; X is 2 and Y is 1; X is 2 and Y is 2; X is 2 and Y is 3; X is 2 and Y is 4; X is 2 and Y is 5; X is 2 and Y is 6; X is 2 and Y is 7; X is 2 and Y is 8; X is 2 and Y is 9; X is 2 and Y is 10; X is 2 and Y is 11; X is 2 and Y is 12; X is 2 and Y is 13; X is 2 and Y is 14; X is 2 and Y is 15; X is 2 and Y is 16; X is 2 and Y is 17; X is 2 and Y is 18; X is 2 and Y is 19; X is 2 and Y is 20; X is 2 and Y is 21; X is 2 and Y is 22; X is 2 and Y is 23; X is 2 and Y is 24; X is 2 and Y is 25; X is 2 and Y is 26; X is 2 and Y is 27; X is 2 and Y is 28; X is 2 and Y is 29; X is 2 and Y is 30; X is 2 and Y is 31; X is 2 and Y is 32; X is 2 and Y is 33; X is 2 and Y is 34; X is 2 and Y is 35; X is 2 and Y is 36; X is 2 and Y is 37; X is 2 and Y is 38; X is 2 and Y is 39; X is 2 and Y is 40; X is 2 and Y is 41; X is 2 and Y is 42; X is 2 and Y is 43; X is 2 and Y is 44; X is 2 and Y is 45; X is 2 and Y is 46; X is 2 and Y is 47; X is 2 and Y is 48; X is 2 and Y is 49; X is 2 and Y is 50; X is 2 and Y is 51; X is 2 and Y is 52; X is 2 and Y is 53; X is 2 and Y is 54; X is 2 and Y is 55; X is 2 and Y is 56; X is 2 and Y is 57; X is 2 and Y is 58; X is 2 and Y is 59; X is 2 and Y is 60; X is 2 and Y is 61; X is 2 and Y is 62; X is 2 and Y is 63; X is 2 and Y is 64; X is 2 and Y is 65; X is 2 and Y is 66; X is 2 and Y is 67; X is 2 and Y is 68; X is 2 and Y is 69; X is 2 and Y is 70; X is 2 and Y is 71; X is 2 and Y is 72; X is 2 and Y is 73; X is 2 and Y is 74; X is 2 and Y is 75; X is 2 and Y is 76; X is 2 and Y is 77; X is 2 and Y is 78; X is 2 and Y is 79; X is 2 and Y is 80; X is 2 and Y is 81; X is 2 and Y is 82; X is 2 and Y is 83; X is 2 and Y is 84; X is 2 and Y is 85; X is 2 and Y is 86; X is 2 and Y is 87; X is 2 and Y is 88; X is 2 and Y is 89; X is 2 and Y is 90; X is 2 and Y is 91; X is 2 and Y is 92; X is 2 and Y is 93; X is 2 and Y is 94; X is 2 and Y is 95; X is 2 and Y is 96; X is 2 and Y is 97; X is 2 and Y is 98; X is 2 and Y is 99; X is 2 and Y is 100; X is 2 and Y is 101; X is 2 and Y is 102; X is 2 and Y is 103; X is 2 and Y is 104; X is 2 and Y is 105; X is 2 and Y is 106; X is 2 and Y is 107; X is 2 and Y is 108; X is 2 and Y is 109; X is 2 and Y is 110; X is 2 and Y is 111; X is 2 and Y is 112; X is 2 and Y is 113; X is 2 and Y is 114; X is 2 and Y is 115; X is 2 and Y is 116; X is 2 and Y is 117; X is 2 and Y is 118; X is 2 and Y is 119; X is 2 and Y is 120; X is 2 and Y is 121; X is 2 and Y is 122; X is 2 and Y is 123; X is 2 and Y is 124; X is 2 and Y is 125; X is 2 and Y is 126; X is 2 and Y is 127; X is 2 and Y is 128; X is 2 and Y is 129; X is 2 and Y is 130; X is 2 and Y is 131; X is 2 and Y is 132; X is 2 and Y is 133; X is 2 and Y is 134; X is 2 and Y is 135; X is 2 and Y is 136; X is 2 and Y is 137; X is 2 and Y is 138; X is 2 and Y is 139; X is 2 and Y is 140; X is 2 and is 141; X is 2 and Y is 142; X is 2 and Y is 143; X is 2 and Y is 144; X is 2 and Y is 145; X is 2 and Y is 146; X is 2 and Y is 147; X is 2 and Y is 148; X is 2 and Y is 149; X is 2 and Y is 150; X is 2 and Y is 151; X is 2 and Y is 152; X is 2 and Y is 153; X is 2 and Y is 154; X is 2 and Y is 155; X is 2 and Y is 156; X is 2 and Y is 157; X is 2 and Y is 158; X is 2 and Y is 159; X is 2 and Y is 160; X is 2 and Y is 161; X is 2 and Y is 162; X is 2 and Y is 163; X is 2 and Y is 164; X is 2 and Y is 165; X is 2 Y is 166; X is 2 and Y is 167; X is 2 and Y is 168; X is 2 and Y is 169; X is 2 and Y is 170; X is 2 and Y is 171; X is 2 and Y is 172; X is 2 and Y is 173; X is 2 and Y is 174; X is 2 and Y is 175; X is 2 and Y is 176; X is 2 and Y is 177; X is 2 and Y is 178; X is 2 and Y is 179; X is 2 and Y is 180; X is 2 and Y is 181; X is 2 and Y is 182; X is 2 and Y is 183; X is 2 and Y is 184; X is 2 and Y is 185; X is 2 and Y is 186; X is 3 and Y is 1; X is 3 and Y is 2; X is 3 and Y is 3; X is 3 and Y is 4; X is 3 and Y is 5; X is 3 and Y is 6; X is 3 and Y is 7; X is 3 and Y is 8; X is 3 and Y is 9; X is 3 and Y is 10; X is 3 and Y is 11; X is 3 and Y is 12; X is 3 and Y is 13; X is 3 and Y is 14; X is 3 and Y is 15; X is 3 and Y is 16; X is 3 and Y is 17; X is 3 and Y is 18; X is 3 and Y is 19; X is 3 and Y is 20; X is 3 and Y is 21; X is 3 and Y is 22; X is 3 and Y is 23; X is 3 and Y is 24; X is 3 and Y is 25; X is 3 and Y is 26; X is 3 and Y is 27; X is 3 and Y is 28; X is 3 and Y is 29; X is 3 and Y is 30; X is 3 and Y is 31; X is 3 and Y is 32; X is 3 and Y is 33; X is 3 and Y is 34; X is 3 and Y is 35; X is 3 and Y is 36; X is 3 and Y is 37; X is 3 and Y is 38; X is 3 and Y is 39; X is 3 and Y is 40; X is 3 and Y is 41; X is 3 and Y is 42; X is 3 and Y is 43; X is 3 and Y is 44; X is 3 and Y is 45; X is 3 and Y is 46; X is 3 and Y is 47; X is 3 and Y is 48; X is 3 and Y is 49; X is 3 and Y is 50; X is 3 and Y is 51; X is 3 and Y is 52; X is 3 and Y is 53; X is 3 and Y is 54; X is 3 and Y is 55; X is 3 and Y is 56; X is 3 and Y is 57; X is 3 and Y is 58; X is 3 and Y is 59; X is 3 and Y is 60; X is 3 and Y is 61; X is 3 and Y is 62; X is 3 and Y is 63; X is 3 and Y is 64; X is 3 and Y is 65; X is 3 and Y is 66; X is 3 and Y is 67; X is 3 and Y is 68; X is 3 and Y is 69; X is 3 and Y is 70; X is 3 and Y is 71; X is 3 and Y is 72; X is 3 and Y is 73; X is 3 and Y is 74; X is 3 and Y is 75; X is 3 and Y is 76; X is 3 and Y is 77; X is 3 and Y is 78; X is 3 and Y is 79; X is 3 and Y is 80; X is 3 and Y is 81; X is 3 and Y is 82; X is 3 and Y is 83; X is 3 and Y is 84; X is 3 and Y is 85; X is 3 and Y is 86; X is 3 and Y is 87; X is 3 and Y is 88; X is 3 and Y is 89; X is 3 and Y is 90; X is 3 and Y is 91; X is 3 and Y is 92; X is 3 and Y is 93; X is 3 and Y is 94; X is 3 and Y is 95; X is 3 and Y is 96; X is 3 and Y is 97; X is 3 and Y is 98; X is 3 and Y is 99; X is 3 and Y is 100; X is 3 and Y is 101; X is 3 and Y is 102; X is 3 and Y is 103; X is 3 and Y is 104; X is 3 and Y is 105; X is 3 and Y is 106; X is 3 and Y is 107; X is 3 and Y is 108; X is 3 and Y is 109; X is 3 and Y is 110; X is 3 and Y is 111; X is 3 and Y is 112; X is 3 and Y is 113; X is 3 and Y is 114; X is 3 and Y is 115; X is 3 and Y is 116; X is 3 and Y is 117; X is 3 and Y is 118; X is 3 and Y is 119; X is 3 and Y is 120; X is 3 and Y is 121; X is 3 and Y is 122; X is 3 and Y is 123; X is 3 and Y is 124; X is 3 and Y is 125; X is 3 and Y is 126; X is 3 and Y is 127; X is 3 and Y is 128; X is 3 and Y is 129; X is 3 and Y is 130; X is 3 and Y is 131; X is 3 and Y is 132; X is 3 and Y is 133; X is 3 and Y is 134; X is 3 and Y is 135; X is 3 and Y is 136; X is 3 and Y is 137; X is 3 and Y is 138; X is 3 and Y is 139; X is 3 and Y is 140; X is 3 and Y is 141; X is 3 and Y is 142; X is 3 and Y is 143; X is 3 and Y is 144; X is 3 and Y is 145; X is 3 and Y is 146; X is 3 and Y is 147; X is 3 and Y is 148; X is 3 and Y is 149; X is 3 and Y is 150; X is 3 and Y is 151; X is 3 and Y is 152; X is 3 and Y is 153; X is 3 and Y is 154; X is 3 and Y is 155; X is 3 and Y is 156; X is 3 and Y is 157; X is 3 and Y is 158; X is 3 and Y is 159; X is 3 and Y is 160; X is 3 and Y is 161; X is 3 and Y is 162; X is 3 and Y is 163; X is 3 and Y is 164; X is 3 and Y is 165; X is 3 and Y is 166; X is 3 and Y is 167; X is 3 and Y is 168; X is 3 and Y is 169; X is 3 and Y is 170; X is 3 and Y is 171; X is 3 and Y is 172; X is 3 and Y is 173; X is 3 and Y is 174; X is 3 and Y is 175; X is 3 and Y is 176; X is 3 and Y is 177; X is 3 and Y is 178; X is 3 and Y is 179; X is 3 and Y is 180; X is 3 and Y is 181; X is 3 and Y is 182; X is 3 and Y is 183; X is 3 and Y is 184; X is 3 and Y is 185; X is 3 and Y is 186; X is 4 and Y is 1; X is 4 and Y is 2; X is 4 and Y is 3; X is 4 and Y is 4; X is 4 and Y is 5; X is 4 and Y is 6; X is 4 and Y is 7; X is 4 and Y is 8; X is 4 and Y is 9; X is 4 and Y is 10; X is 4 and Y is 11; X is 4 and Y is 12; X is 4 and Y is 13; X is 4 and Y is 14; X is 4 and Y is 15; X is 4 and Y is 16; X is 4 and Y is 17; X is 4 and Y is 18; X is 4 and Y is 19; X is 4 and Y is 20; X is 4 and Y is 21; X is 4 and Y is 22; X is 4 and Y is 23; X is 4 and Y is 24; X is 4 and Y is 25; X is 4 and Y is 26; X is 4 and Y is 27; X is 4 and Y is 28; X is 4 and Y is 29; X is 4 and Y is 30; X is 4 and Y is 31; X is 4 and Y is 32; X is 4 and Y is 33; X is 4 and Y is 34; X is 4 and Y is 35; X is 4 and Y is 36; X is 4 and Y is 37; X is 4 and Y is 38; X is 4 and Y is 39; X is 4 and Y is 40; X is 4 and Y is 41; X is 4 and Y is 42; X is 4 and Y is 43; X is 4 and Y is 44; X is 4 and Y is 45; X is 4 and Y is 46; X is 4 and Y is 47; X is 4 and Y is 48; X is 4 and Y is 49; X is 4 and Y is 50, X is 4 and Y is 51; X is 4 and Y is 52; X is 4 and Y is 53; X is 4 and Y is 54; X is 4 and Y is 55; X is 4 and Y is 56; X is 4 and Y is 57; X is 4 and Y is 58; X is 4 and Y is 59; X is 4 and Y is 60; X is 4 and Y is 61; X is 4 and Y is 62; X is 4 and Y is 63; X is 4 and Y is 64; X is 4 and Y is 65; X is 4 and Y is 66; X is 4 and Y is 67; X is 4 and Y is 68; X is 4 and Y is 69; X is 4 and Y is 70; X is 4 and Y is 71; X is 4 and Y is 72; X is 4 and Y is 73; X is 4 and Y is 74; X is 4 and Y is 75; X is 4 and Y is 76, X is 4 and Y is 77; X is 4 and Y is 78; X is 4 and Y is 79; X is 4 and Y is 80; X is 4 and Y is 81; X is 4 and Y is 82; X is 4 and Y is 83; X is 4 and Y is 84; X is 4 and Y is 85; X is 4 and Y is 86; X is 4 and Y is 87; X is 4 and Y is 88; X is 4 and Y is 89; X is 4 and Y is 90; X is 4 and Y is 91; X is 4 and Y is 92; X is 4 and Y is 93; X is 4 and Y is 94; X is 4 and Y is 95; X is 4 and Y is 96; X is 4 and Y is 97; X is 4 and Y is 98; X is 4 and Y is 99; X is 4 and Y is 100; X is 4 and Y is 101; X is 4 and Y is 102; X is 4 and Y is 103; X is 4 and Y is 104; X is 4 and Y is 105; X is 4 and Y is 106; X is 4 and Y is 107; X is 4 and Y is 108; X is 4 and Y is 109; X is 4 and Y is 110; X is 4 and Y is 111; X is 4 and Y is 112; X is 4 and Y is 113; X is 4 and Y is 114; X is 4 and Y is 115; X is 4 and Y is 116; X is 4 and Y is 117; X is 4 and Y is 118; X is 4 and Y is 119; X is 4 and Y is 120; X is 4 and Y is 121; X is 4 and Y is 122; X is 4 and Y is 123; X is 4 and Y is 124; X is 4 and Y is 125; X is 4 and Y is 126; X is 4 and Y is 127; X is 4 and Y is 128; X is 4 and Y is 129; X is 4 and Y is 130; X is 4 and Y is 131; X is 4 and Y is 132; X is 4 and Y is 133; X is 4 and Y is 134; X is 4 and Y is 135; X is 4 and Y is 136; X is 4 and Y is 137; X is 4 and Y is 138; X is 4 and Y is 139; X is 4 and Y is 140; X is 4 and Y is 141; X is 4 and Y is 142; X is 4 and Y is 143; X is 4 and Y is 144; X is 4 and Y is 145; X is 4 and Y is 146; X is 4 and Y is 147; X is 4 and Y is 148; X is 4 and Y is 149; X is 4 and Y is 150; X is 4 and Y is 151; X is 4 and Y is 152; X is 4 and Y is 153; X is 4 and Y is 154; X is 4 and Y is 155; X is 4 and Y is 156; X is 4 and Y is 157; X is 4 and Y is 158; X is 4 and Y is 159; X is 4 and Y is 160; X is 4 and Y is 161; X is 4 and Y is 162; X is 4 and Y is 163; X is 4 and Y is 164; X is 4 and Y is 165; X is 4 and Y is 166; X is 4 and Y is 167; X is 4 and Y is 168; X is 4 and Y is 169; X is 4 and Y is 170; X is 4 and Y is 171; X is 4 and Y is 172; X is 4 and Y is 173; X is 4 and Y is 174; X is 4 and Y is 175; X is 4 and Y is 176; X is 4 and Y is 177; X is 4 and Y is 178; X is 4 and Y is 179; X is 4 and Y is 180; X is 4 and Y is 181; X is 4 and Y is 182; X is 4 and Y is 183; X is 4 and Y is 184; X is 4 and Y is 185; X is 4 and Y is 186; X is 5 and Y is 1; X is 5 and Y is 2; X is 5 and Y is 3; X is 5 and Y is 4; X is 5 and Y is 5; X is 5 and Y is 6; X is 5 and Y is 7; X is 5 and Y is R; X is 5 and Y is 9; X is 5 and Y is 10; X is 5 and Y is 11; X is 5 and Y is 12; X is 5 and Y is 13; X is 5 and Y is 14; X is 5 and Y is 15; X is 5 and Y is 16; X is 5 and Y is 17; X is 5 and Y is 18; X is 5 and Y is 19; X is 5 and Y is 20; X is 5 and Y is 21; X is 5 and Y is 22; X is 5 and Y is 23; X is 5 and Y is 24; X is 5 and Y is 25; X is 5 and Y is 26; X is 5 and Y is 27; X is 5 and Y is 28; X is 5 and Y is 29; X is 5 and Y is 30; X is 5 and Y is 31; X is 5 and Y is 32; X is 5 and Y is 33; X is 5 and Y is 34; X is 5 and Y is 35; X is 5 and Y is 36; X is 5 and Y is 37; X is 5 and Y is 38; X is 5 and Y is 39; X is 5 and Y is 40; X is 5 and Y is 41; X is 5 and Y is 42; X is 5 and Y is 43; X is 5 and Y is 44; X is 5 and Y is 45; X is 5 and Y is 46; X is 5 and Y is 47; X is 5 and Y is 48; X is 5 and Y is 49; X is 5 and Y is 50; X is 5 and Y is 51; X is 5 and Y is 52; X is 5 and Y is 53; X is 5 and Y is 54; X is 5 and Y is 55; X is 5 and Y is 56; X is 5 and Y is 57; X is 5 and Y is 58; X is 5 and Y is 59; X is 5 and Y is 60; X is 5 and Y is 61; X is 5 and Y is 62; X is 5 and Y is 63; X is 5 and Y is 64; X is 5 and Y is 65; X is 5 and Y is 66; X is 5 and Y is 67; X is 5 and Y is 68; X is 5 and Y is 69; X is 5 and Y is 70; X is 5 and Y is 71; X is 5 and Y is 72; X is 5 and Y is 73; X is 5 and Y is 74; X is 5 and Y is 75; X is 5 and Y is 76; X is 5 and Y is 77; X is 5 and Y is 78; X is 5 and Y is 79; X is 5 and Y is 80; X is 5 and Y is 81; X is 5 and Y is 82; X is 5 and Y is 83; X is 5 and Y is 84; X is 5 and is 85; X is 5 and Y is 86; X is 5 and Y is 87; X is 5 and Y is 88; X is 5 and Y is 89; X is 5 and Y is 90; X is 5 and Y is 91; X is 5 and Y is 92; X is 5 and Y is 93; X is 5 and Y is 94; X is 5 and Y is 95; X is 5 and Y is 96; X is 5 and Y is 97; X is 5 and Y is 98; X is 5 and Y is 99; X is 5 and Y is 100; X is 5 and Y is 101; X is 5 and Y is 102; X is 5 and Y is 103; X is 5 and Y is 104; X is 5 and Y is 105; X is 5 and Y is 106; X is 5 and Y is 107; X is 5 and Y is 108; X is 5 and Y is 109; X is 5 and Y is 110; X is 5 and Y is 111; X is 5 and Y is 112; X is 5 and Y is 113; X is 5 and Y is 114; X is 5 and Y is 115; X is 5 and Y is 116; X is 5 and Y is 117; X is 5 and Y is 118; X is 5 and Y is 119; X is 5 and Y is 120; X is 5 and Y is 121; X is 5 and Y is 122; X is 5 and Y is 123; X is 5 and Y is 124; X is 5 and Y is 125; X is 5 and Y is 126; X is 5 and Y is 127; X is 5 and Y is 128; X is 5 and Y is 129; X is 5 and Y is 130; X is 5 and Y is 131; X is 5 and Y is 132; X is 5 and Y is 133; X is 5 and Y is 134; X is 5 and Y is 135; X is 5 and Y is 136; X is 5 and Y is 137; X is 5 and Y is 138; X is 5 and Y is 139; X is 5 and Y is 140; X is 5 and Y is 141; X is 5 and Y is 142; X is 5 and Y is 143; X is 5 and Y is 144; X is 5 and Y is 145; X is 5 and Y is 146; X is 5 and Y is 147; X is 5 and Y is 148; X is 5 and Y is 149; X is 5 and Y is 150; X is 5 and Y is 151; X is 5 and is 152; X is 5 and Y is 153; X is 5 and Y is 154; X is 5 and Y is 155; X is 5 and Y is 156; X is 5 and Y is 157; X is 5 and Y is 158; X is 5 and Y is 159; X is 5 and Y is 160; X is 5 and Y is 161; X is 5 and Y is 162; X is 5 and Y is 163; X is 5 and Y is 164; X is 5 and Y is 165; X is 5 and Y is 166; X is 5 and Y is 167; X is 5 and Y is 168; X is 5 and Y is 169; X is 5 and Y is 170; X is 5 and Y is 171; X is 5 and Y is 172; X is 5 and Y is 173; X is 5 and Y is 174; X is 5 and Y is 175; X is 5 and Y is 176; X is 5 and Y is 177; X is 5 and Y is 178; X is 5 and Y is 179; X is 5 and Y is 180; X is 5 and Y is 181; X is 5 and Y is 182; X is 5 and Y is 183; X is 5 and Y is 184; X is 5 and Y is 185; X is 5 and Y is 186; X is 6 and Y is 1; X is 6 and Y is 2; X is 6 and Y is 3; X is 6 and Y is 4; X is 6 and Y is 5; X is 6 and Y is 6; X is 6 and Y is 7; X is 6 and Y is 8; X is 6 and Y is 9; X is 6 and Y is 10; X is 6 and Y is 11; X is 6 and Y is 12; X is 6 and Y is 13; X is 6 and Y is 14; X is 6 and Y is 15; X is 6 and Y is 16; X is 6 and Y is 17; X is 6 and Y is 18; X is 6 and Y is 19; X is 6 and Y is 20; X is 6 and Y is 21; X is 6 and Y is 22; X is 6 and Y is 23; X is 6 and Y is 24; X is 6 and Y is 25; X is 6 and Y is 26; X is 6 and Y is 27; X is 6 and Y is 28; X is 6 and Y is 29; X is 6 and Y is 30; X is 6 and Y is 31; X is 6 and Y is 32; X is 6 and Y is 33; X is 6 and Y is 34; X is 6 and Y is 35; X is 6 and Y is 36; X is 6 and Y is 37; X is 6 and Y is 38; X is 6 and Y is 39; X is 6 and Y is 40; X is 6 and Y is 41; X is 6 and Y is 42; X is 6 and Y is 43; X is 6 and Y is 44; X is 6 and Y is 45; X is 6 and Y is 46; X is 6 and Y is 47; X is 6 and Y is 48; X is 6 and Y is 49; X is 6 and Y is 50; X is 6 and Y is 51; X is 6 and Y is 52; X is 6 and Y is 53; X is 6 and Y is 54; X is 6 and Y is 55; X is 6 and Y is 56; X is 6 and Y is 57; X is 6 and Y is 58; X is 6 and Y is 59; X is 6 and Y is 60; X is 6 and Y is 61; X is 6 and Y is 62; X is 6 and Y is 63; X is 6 and Y is 64; X is 6 and Y is 65; X is 6 and Y is 66; X is 6 and Y is 67; X is 6 and Y is 68; X is 6 and Y is 69; X is 6 and Y is 70; X is 6 and Y is 71; X is 6 and Y is 72; X is 6 and Y is 73; X is 6 and Y is 74; X is 6 and Y is 75; X is 6 and Y is 76; X is 6 and Y is 77; X is 6 and Y is 78; X is 6 and Y is 79; X is 6 and Y is 80; X is 6 and Y is 81; X is 6 and Y is 82; X is 6 and Y is 83; X is 6 and Y is 84; X is 6 and Y is 85; X is 6 and Y is 86; X is 6 and Y is 87; X is 6 and Y is 88; X is 6 and Y is 89; X is 6 and Y is 90; X is 6 and Y is 91; X is 6 and Y is 92; X is 6 and Y is 93; X is 6 and Y is 94; X is 6 and Y is 95; X is 6 and Y is 96; X is 6 and Y is 97; X is 6 and Y is 98; X is 6 and Y is 99; X is 6 and Y is 100; X is 6 and Y is 101; X is 6 and Y is 102; X is 6 and Y is 103; X is 6 and Y is 104; X is 6 and Y is 105; X is 6 and Y is 106; X is 6 and Y is 107; X is 6 and Y is 108; X is 6 and Y is 109; X is 6 and Y is 110; X is 6 and Y is 111; X is 6 and Y is 112; X is 6 and Y is 113; X is 6 and Y is 114; X is 6 and Y is 115; X is 6 and Y is 116; X is 6 and Y is 117; X is 6 and Y is 118; X is 6 and Y is 119; X is 6 and Y is 120; X is 6 and Y is 121; X is 6 and Y is 122; X is 6 and Y is 123; X is 6 and Y is 124; X is 6 and Y is 125; X is 6 and Y is 126; X is 6 and Y is 127; X is 6 and Y is 128; X is 6 and Y is 129; X is 6 and Y is 130; X is 6 and Y is 131; X is 6 and Y is 132; X is 6 and Y is 133; X is 6 and Y is 134; X is 6 and Y is 135; X is 6 and Y is 136; X is 6 and Y is 137; X is 6 and Y is 138; X is 6 and Y is 139; X is 6 and Y is 140; X is 6 and Y is 141; X is 6 and Y is 142; X is 6 and Y is 143; X is 6 and Y is 144; X is 6 and Y is 145; X is 6 and Y is 146; X is 6 and Y is 147; X is 6 and Y is 148; X is 6 and Y is 149; X is 6 and Y is 150; X is 6 and Y is 151; X is 6 and Y is 152; X is 6 and Y is 153; X is 6 and Y is 154; X is 6 and Y is 155; X is 6 and Y is 156; X is 6 and Y is 157; X is 6 and Y is 158; X is 6 and Y is 159; X is 6 and Y is 160; X is 6 and Y is 161; X is 6 and Y is 162; X is 6 and Y is 163; X is 6 and Y is 164; X is 6 and Y is 165; X is 6 and Y is 166; X is 6 and Y is 167; X is 6 and Y is 168; X is 6 and Y is 169; X is 6 and Y is 170; X is 6 and Y is 171; X is 6 and Y is 172; X is 6 and Y is 173; X is 6 and Y is 174; X is 6 and Y is 175; X is 6 and Y is 176; X is 6 and Y is 177; X is 6 and Y is 178; X is 6 and Y is 179; X is 6 and Y is 180; X is 6 and Y is 181; X is 6 and Y is 182; X is 6 and Y is 183; X is 6 and Y is 184; X is 6 and Y is 185; X is 6 and Y is 186; X is 7 and Y is 1; X is 7 and Y is 2; X is 7 and Y is 3; X is 7 and Y is 4; X is 7 and Y is 5; X is 7 and Y is 6; X is 7 and Y is 7; X is 7 and Y is 8; X is 7 and Y is 9; X is 7 and Y is 10; X is 7 and Y is 11; X is 7 and Y is 12; X is 7 and Y is 13; X is 7 and Y is 14; X is 7 and Y is 15; X is 7 and Y is 16; X is 7 and Y is 17; X is 7 and Y is 18; X is 7 and Y is 19; X is 7 and Y is 20; X is 7 and Y is 21; X is 7 and Y is 22; X is 7 and Y is 23; X is 7 and Y is 24; X is 7 and Y is 25; X is 7 and Y is 26; X is 7 and Y is 27; X is 7 and Y is 28; X is 7 and Y is 29; X is 7 and Y is 30; X is 7 and Y is 31; X is 7 and Y is 32; X is 7 and Y is 33; X is 7 and Y is 34; X is 7 and Y is 35; X is 7 and Y is 36; X is 7 and Y is 37; X is 7 and Y is 38; X is 7 and Y is 39; X is 7 and Y is 40; X is 7 and Y is 41; X is 7 and Y is 42; X is 7 and Y is 43; X is 7 and Y is 44; X is 7 and Y is 45; X is 7 and Y is 46; X is 7 and Y is 47; X is 7 and Y is 48; X is 7 and Y is 49; X is 7 and Y is 50; X is 7 and Y is 51; X is 7 and Y is 52; X is 7 and Y is 53; X is 7 and Y is 54; X is 7 and Y is 55; X is 7 and Y is 56; X is 7 and Y is 57; X is 7 and Y is 58; X is 7 and Y is 59; X is 7 and Y is 60; X is 7 and Y is 61; X is 7 and Y is 62; X is 7 and Y is 63; X is 7 and Y is 64; X is 7 and Y is 65; X is 7 and Y is 66; X is 7 and Y is 67; X is 7 and Y is 68; X is 7 and Y is 69; X is 7 and Y is 70; X is 7 and Y is 71; X is 7 and Y is 72; X is 7 and Y is 73; X is 7 and Y is 74; X is 7 and Y is 75; X is 7 and Y is 76; X is 7 and Y is 77; X is 7 and Y is 78; X is 7 and Y is 79; X is 7 and Y is 80; X is 7 and Y is 81; X is 7 and Y is 82; X is 7 and Y is 83; X is 7 and Y is 84; X is 7 and Y is 85; X is 7 and Y is 86; X is 7 and Y is 87; X is 7 and Y is 88; X is 7 and Y is 89; X is 7 and Y is 90; X is 7 and Y is 91; X is 7 and Y is 92; X is 7 and Y is 93; X is 7 and Y is 94; X is 7 and Y is 95; X is 7 and Y is 96; X is 7 and Y is 97; X is 7 and Y is 98; X is 7 and Y is 99; X is 7 and Y is 100; X is 7 and Y is 101; X is 7 and Y is 102; X is 7 and Y is 103; X is 7 and Y is 104; X is 7 and Y is 105; X is 7 and Y is 106; X is 7 and Y is 107; X is 7 and Y is 108; X is 7 and Y is 109; X is 7 and Y is 110; X is 7 and Y is 111; X is 7 and Y is 112; X is 7 and Y is 113; X is 7 and Y is 114; X is 7 and Y is 115; X is 7 and Y is 116; X is 7 and Y is 117; X is 7 and Y is 118; X is 7 and Y is 119; X is 7 and Y is 120; X is 7 and Y is 121; X is 7 and Y is 122; X is 7 and Y is 123; X is 7 and Y is 124; X is 7 and Y is 125; X is 7 and Y is 126; X is 7 and Y is 127; X is 7 and Y is 128; X is 7 and Y is 129; X is 7 and Y is 130; X is 7 and Y is 131; X is 7 and Y is 132; X is 7 and Y is 133; X is 7 and Y is 134; X is 7 and Y is 135; X is 7 and Y is 136; X is 7 and Y is 137; X is 7 and Y is 138; X is 7 and Y is 139; X is 7 and Y is 140; X is 7 and Y is 141; X is 7 and Y is 142; X is 7 and Y is 143; X is 7 and Y is 144; X is 7 and Y is 145; X is 7 and Y is 146; X is 7 and Y is 147; X is 7 and Y is 148; X is 7 and Y is 149; X is 7 and Y is 150; X is 7 and Y is 151; X is 7 and Y is 152; X is 7 and Y is 153; X is 7 and Y is 154; X is 7 and Y is 155; X is 7 and Y is 156; X is 7 and Y is 157; X is 7 and Y is 158; X is 7 and Y is 159; X is 7 and Y is 160; X is 7 and Y is 161; X is 7 and Y is 162; X is 7 and Y is 163; X is 7 and Y is 164; X is 7 and Y is 165; X is 7 and Y is 166; X is 7 and Y is 167; X is 7 and Y is 168; X is 7 and Y is 169; X is 7 and Y is 170; X is 7 and Y is 171; X is 7 and Y is 172; X is 7 and Y is 173; X is 7 and Y is 174; X is 7 and Y is 175; X is 7 and Y is 176; X is 7 and Y is 177; X is 7 and Y is 178; X is 7 and Y is 179; X is 7 and Y is 180; X is 7 and Y is 181; X is 7 and Y is 182; X is 7 and Y is 183; X is 7 and Y is 184; X is 7 and Y is 185; X is 7 and Y is 186; X is 8 and Y is 1; X is 8 all 1 is 2; X is 8 and Y is 3; X is 8 and Y is 4; X is 8 and Y is 5; X is 8 and Y is 6; X is 8 and Y is 7; X is 8 and Y is 8; X is 8 and Y is 9; X is 8 and Y is 10; X is 8 and Y is 11; X is 8 and Y is 12; X is 8 and Y is 13; X is 8 and Y is 14; X is 8 and Y is 15; X is 8 and Y is 16; X is 8 and Y is 17; X is 8 and Y is 18; X is 8 and Y is 19; X is 8 and Y is 20; X is 8 and Y is 21; X is 8 and Y is 22; X is 8 and Y is 23; X is 8 and Y is 24; X is 8 and Y is 25; X is 8 and Y is 26; X is 8 and Y is 27; X is 8 and Y is 28; X is 8 and Y is 29; X is 8 and Y is 30; X is 8 and Y is 31; X is 8 and Y is 32; X is 8 and Y is 33; X is 8 and Y is 34; X is 8 and Y is 35; X is 8 and Y is 36; X is 8 and Y is 37; X is 8 and Y is 38; X is 8 and Y is 39; X is 8 and Y is 40; X is 8 and Y is 41; X is 8 and Y is 42; X is 8 and Y is 43; X is 8 and Y is 44; X is 8 and Y is 45; X is 8 and Y is 46; X is 8 and Y is 47; X is 8 and Y is 48; X is 8 and Y is 49; X is 8 and Y is 50; X is 8 and Y is 51; X is 8 and Y is 52; X is 8 and Y is 53; X is 8 and Y is 54; X is 8 and Y is 55; X is 8 and Y is 56; X is 8 and Y is 57; X is 8 and Y is 58; X is 8 and Y is 59; X is 8 and Y is 60; X is 8 and Y is 61; X is 8 and Y is 62; X is 8 and Y is 63; X is 8 and Y is 64; X is 8 and Y is 65; X is 8 and Y is 66; X is 8 and Y is 67; X is 8 and Y is 68; X is 8 and Y is 69; X is 8 and Y is 70; X is 8 and Y is 71; X is 8 and Y is 72; X is 8 and Y is 73; X is 8 and Y is 74; X is 8 and Y is 75; X is 8 and Y is 76; X is 8 and Y is 77; X is 8 and Y is 78; X is 8 and Y is 79; X is 8 and Y is 80; X is 8 and Y is 81; X is 8 and Y is 82; X is 8 and Y is 83; X is 8 and Y is 84; X is 8 and Y is 85; X is 8 and Y is 86; X is 8 and Y is 87; X is 8 and Y is 88; X is 8 and Y is 89; X is 8 and Y is 90; X is 8 and Y is 91; X is 8 and Y is 92; X is 8 and Y is 93; X is 8 and Y is 94; X is 8 and Y is 95; X is 8 and Y is 96; X is 8 and Y is 97; X is 8 and Y is 98; X is 8 and Y is 99; X is 8 and Y is 100; X is 8 and Y is 101; X is 8 and Y is 102; X is 8 and Y is 103; X is 8 and Y is 104; X is 8 and Y is 105; X is 8 and Y is 106; X is 8 and Y is 107; X is 8 and Y is 108; X is 8 and Y is 109; X is 8 and Y is 110; X is 8 and Y is 111; X is 8 and Y is 112; X is 8 and Y is 113; X is 8 and Y is 114; X is 8 and Y is 115; X is 8 and Y is 116; X is 8 and Y is 117; X is 8 and Y is 118; X is 8 and Y is 119; X is 8 and Y is 120; X is 8 and Y is 121; X is 8 and Y is 122; X is 8 and Y is 123; X is 8 and Y is 124; X is 8 and Y is 125; X is 8 and Y is 126; X is 8 and Y is 127; X is 8 and Y is 128; X is 8 and Y is 129; X is 8 and Y is 130; X is 8 and Y is 131; X is 8 and Y is 132;

X is 8 and Y is 133; X is 8 and Y is 134; X is 8 and Y is 135; X is 8 and Y is 136; X is 8 and Y is 137; X is 8 and Y is 138; X is 8 and Y is 139; X is 8 and Y is 140; X is 8 and Y is 141; X is 8 and Y is 142; X is 8 and Y is 143; X is 8 and Y is 144; X is 8 and Y is 145; X is 8 and Y is 146; X is 8 and Y is 147; X is 8 and Y is 148; X is 8 and Y is 149; X is 8 and Y is 150; X is 8 and Y is 151; X is 8 and Y is 152; X is 8 and Y is 153; X is 8 and Y is 154; X is 8 and Y is 155; X is 8 and Y is 156; X is 8 and Y is 157; X is 8 and Y is 158; X is 8 and Y is 159; X is 8 and Y is 160; X is 8 and Y is 161; X is 8 and Y is 162; X is 8 and Y is 163; X is 8 and Y is 164; X is 8 and Y is 165; X is 8 and Y is 166; X is 8 and Y is 167; X is 8 and Y is 168; X is 8 and Y is 169; X is 8 and Y is 170; X is 8 and Y is 171; X is 8 and Y is 172; X is 8 and Y is 173; X is 8 and Y is 174; X is 8 and Y is 175; X is 8 and Y is 176; X is 8 and Y is 177; X is 8 and Y is 178; X is 8 and Y is 179; X is 8 and Y is 180; X is 8 and Y is 181; X is 8 and Y is 182; X is 8 and Y is 183; X is 8 and Y is 184; X is 8 and Y is 185; X is 8 and Y is 186; X is 9 and Y is 1; X is 9 and Y is 2; X is 9 and Y is 3; X is 9 and Y is 4; X is 9 and Y is 5; X is 9 and Y is 6; X is 9 and Y is 7; X is 9 and Y is 8; X is 9 and Y is 9; X is 9 and Y is 10; X is 9 and Y is 11; X is 9 and Y is 12; X is 9 and Y is 13; X is 9 and Y is 14; X is 9 and Y is 15; X is 9 and Y is 16; X is 9 and Y is 17; X is 9 and Y is 18; X is 9 and Y is 19; X is 9 and Y is 20; X is 9 and Y is 21; X is 9 and Y is 22; X is 9 and Y is 23; X is 9 and Y is 24; X is 9 and Y is 25; X is 9 and Y is 26; X is 9 and Y is 27; X is 9 and Y is 28; X is 9 and Y is 29; X is 9 and Y is 30; X is 9 and Y is 31; X is 9 and Y is 32; X is 9 and Y is 33; X is 9 and Y is 34; X is 9 and Y is 35; X is 9 and Y is 36; X is 9 and Y is 37; X is 9 and Y is 38; X is 9 and Y is 39; X is 9 and Y is 40; X is 9 and Y is 41; X is 9 and Y is 42; X is 9 and Y is 43; X is 9 and Y is 44; X is 9 and Y is 45; X is 9 and Y is 46; X is 9 and Y is 47; X is 9 and Y is 48; X is 9 and Y is 49; X is 9 and Y is 50; X is 9 and Y is 51; X is 9 and Y is 52; X is 9 and Y is 53; X is 9 and Y is 54; X is 9 and Y is 55; X is 9 and Y is 56; X is 9 and Y is 57; X is 9 and Y is 58; X is 9 and Y is 59; X is 9 and Y is 60; X is 9 and Y is 61; X is 9 and Y is 62; X is 9 and Y is 63; X is 9 and Y is 64; X is 9 and Y is 65; X is 9 and Y is 66; X is 9 and Y is 67; X is 9 and Y is 68; X is 9 and Y is 69; X is 9 and Y is 70; X is 9 and Y is 71; X is 9 and Y is 72; X is 9 and Y is 73; X is 9 and Y is 74; X is 9 and Y is 75; X is 9 and Y is 76; X is 9 and Y is 77; X is 9 and Y is 78; X is 9 and Y is 79; X is 9 and Y is 80; X is 9 and Y is 81; X is 9 and Y is 82; X is 9 and Y is 83; X is 9 and Y is 84; X is 9 and Y is 85; X is 9 and Y is 86; X is 9 and Y is 87; X is 9 and Y is 88; X is 9 and Y is 89; X is 9 and Y is 90; X is 9 and Y is 91; X is 9 and Y is 92; X is 9 and Y is 93; X is 9 and Y is 94; X is 9 and Y is 95; X is 9 and Y is 96; X is 9 and Y is 97; X is 9 and Y is 98; X is 9 and Y is 99; X is 9 and Y is 100; X is 9 and Y is 101; X is 9 and Y is 102; X is 9 and Y is 103; X is 9 and Y is 104; X is 9 and Y is 105; X is 9 and Y is 106; X is 9 and Y is 107; X is 9 and Y is 108; X is 9 and Y is 109; X is 9 and Y is 110; X is 9 and Y is 111; X is 9 and Y is 112; X is 9 and Y is 113; X is 9 and Y is 114; X is 9 and Y is 115; X is 9 and Y is 116; X is 9 and Y is 117; X is 9 and Y is 118; X is 9 and Y is 119; X is 9 and Y is 120; X is 9 and Y is 121; X is 9 and Y is 122; X is 9 and Y is 123; X is 9 and Y is 124; X is 9 and Y is 125; X is 9 and Y is 126; X is 9 and Y is 127; X is 9 and Y is 128; X is 9 and Y is 129; X is 9 and Y is 130; X is 9 and Y is 131; X is 9 and Y is 132; X is 9 and Y is 133; X is 9 and Y is 134; X is 9 and Y is 135; X is 9 and Y is 136; X is 9 and Y is 137; X is 9 and Y is 138; X is 9 and Y is 139; X is 9 and Y is 140; X is 9 and Y is 141; X is 9 and Y is 142; X is 9 and Y is 143; X is 9 and Y is 144; X is 9 and Y is 145; X is 9 and Y is 146; X is 9 and Y is 147; X is 9 and Y is 148; X is 9 and Y is 149; X is 9 and Y is 150; X is 9 and Y is 151; X is 9 and Y is 152; X is 9 and Y is 153; X is 9 and Y is 154; X is 9 and Y is 155; X is 9 and Y is 156; X is 9 and Y is 157; X is 9 and Y is 158; X is 9 and Y is 159; X is 9 and Y is 160; X is 9 and Y is 161; X is 9 and Y is 162; X is 9 and Y is 163; X is 9 and Y is 164; X is 9 and Y is 165; X is 9 and Y is 166; X is 9 and Y is 167; X is 9 and Y is 168; X is 9 and Y is 169; X is 9 and Y is 170; X is 9 and Y is 171; X is 9 and Y is 172; X is 9 and Y is 173; X is 9 and Y is 174; X is 9 and Y is 175; X is 9 and Y is 176; X is 9 and Y is 177; X is 9 and Y is 178; X is 9 and Y is 179; X is 9 and Y is 180; X is 9 and Y is 181; X is 9 and Y is 182; X is 9 and Y is 183; X is 9 and Y is 184; X is 9 and Y is 185; X is 9 and Y is 186; X is 10 and Y is 1; X is 10 and Y is 2; X is 10 and Y is 3; X is 10 and Y is 4; X is 10 and Y is 5; X is 10 and Y is 6; X is 10 and Y is 7; X is 10 and Y is 8; X is 10 and Y is 9; X is 10 and Y is 10; X is 10 and Y is 11; X is 10 and Y is 12; X is 10 and Y is 13; X is 10 and Y is 14; X is 10 and Y is 15; X is 10 and Y is 16; X is 10 and Y is 17; X is 10 and Y is 18; X is 10 and Y is 19; X is 10 and Y is 20; X is 10 and Y is 21; X is 10 and Y is 22; X is 10 and Y is 23; X is 10 and Y is 24; X is 10 and Y is 25; X is 10 and Y is 26; X is 10 and Y is 27; X is 10 and Y is 28; X is 10 and Y is 29; X is 10 and Y is 30; X is 10 and Y is 31; X is 10 and Y is 32; X is 10 and Y is 33; X is 10 and Y is 34; X is 10 and Y is 35; X is 10 and Y is 36; X is 10 and Y is 37; X is 10 and Y is 38; X is 10 and Y is 39; X is 10 and Y is 40; X is 10 and Y is 41; X is 10 and Y is 42; X is 10 and Y is 43; X is 10 and Y is 44; X is 10 and Y is 45; X is 10 and Y is 46; X is 10 and Y is 47; X is 10 and Y is 48; X is 10 and Y is 49; X is 10 and Y is 50; X is 10 and Y is 51; X is 10 and Y is 52; X is 10 and Y is 53; X is 10 and Y is 54; X is 10 and Y is 55; X is 10 and Y is 56; X is 10 and Y is 57; X is 10 and Y is 58; X is 10 and Y is 59; X is 10 and Y is 60; X is 10 and Y is 61; X is 10 and Y is 62; X is 10 and Y is 63; X is 10 and Y is 64; X is 10 and Y is 65; X is 10 and Y is 66; X is 10 and Y is 67; X is 10 and Y is 68; X is 10 and Y is 69; X is 10 and Y is 70; X is 10 and Y is 71; X is 10 and Y is 72; X is 10 and Y is 73; X is 10 and Y is 74; X is 10 and Y is 75; X is 10 and Y is 76; X is 10 and Y is 77; X is 10 and Y is 78; X is 10 and Y is 79; X is 10 and Y is 80; X is 10 and Y is 81; X is 10 and Y is 82; X is 10 and Y is 83; X is 10 and Y is 84; X is 10 and Y is 85; X is 10 and Y is 86; X is 10 and Y is 87; X is 10 and Y is 88; X is 10 and Y is 89; X is 10 and Y is 90; X is 10 and Y is 91; X is 10 and Y is 92; X is 10 and Y is 93; X is 10 and Y is 94; X is 10 and Y is 95; X is 10 and Y is 96; X is 10 and Y is 97; X is 10 and Y is 98; X is 10 and Y is 99; X is 10 and Y is 100; X is 10 and Y is 101; X is 10 and Y is 102; X is 10 and Y is 103; X is 10 and Y is 104; X is 10 and Y is 105; X is 10 and Y is 106; X is 10 and Y is 107; X is 10 and Y is 108; X is 10 and Y is 109; X is 10 and Y is 110; X is 10 and Y is 111; X is 10 and Y is 112; X is 10 and Y is 113; X is 10 and Y is 114; X is 10 and Y is 115; X is 10 and Y is 116; X is 10 and Y is 117; X is 10 and Y is 118; X is 10 and Y is 119; X is 10 and Y is 120; X is 10 and Y is 121; X is 10 and Y is 122; X is 10 and Y is 123; X is 10 and Y is 124; X is 10 and Y is 125; X is 10 and Y is 126; X is 10 and Y is 127; X is 10 and Y is 128; X is 10 and Y is 129; X is 10 and Y is 130; X is 10 and Y is 131; X is 10 and Y is 132; X is 10 and Y is 133; X is 10 and Y is 134; X is 10 and Y is 135; X is 10 and Y is 136; X is 10 and Y is 137; X is 10 and Y is 138; X is 10 and Y is 139; X is 10 and Y is 140; X is 10 and Y is 141; X is 10 and Y is 142; X is 10 and Y is 143; X is 10 and Y is 144; X is 10 and Y is 145; X is 10 and Y is 146; X is 10 and Y is 147; X is 10 and Y is 148; X is 10 and Y is 149; X is 10 and Y is 150; X is 10 and Y is 151; X is 10 and Y is 152; X is 10 and Y is 153; X is 10 and Y is 154; X is 10 and Y is 155; X is 10 and Y is 156; X is 10 and Y is 157; X is 10 and Y is 158; X is 10 and Y is 159; X is 10 and Y is 160; X is 10 and Y is 161; X is 10 and Y is 162; X is 10 and Y is 163; X is 10 and Y is 164; X is 10 and Y is 165; X is 10 and Y is 166; X is 10 and Y is 167; X is 10 and Y is 168; X is 10 and Y is 169; X is 10 and Y is 170; X is 10 and Y is 171; X is 10 and Y is 172; X is 10 and Y is 173; X is 10 and Y is 174; X is 10 and Y is 175; X is 10 and Y is 176; X is 10 and Y is 177; X is 10 and Y is 178; X is 10 and Y is 179; X is 10 and Y is 180; X is 10 and Y is 181; X is 10 and Y is 182; X is 10 and Y is 183; X is 10 and Y is 184; X is 10 and Y is 185; X is 10 and Y is 186; X is 11 and Y is 1; X is 11 and Y is 2; X is 11 and Y is 3; X is 11 and Y is 4; X is 11 and Y is 5; X is 11 and Y is 6; X is 11 and Y is 7; X is 11 and Y is 8; X is 11 and Y is 9; X is 11 and Y is 10; X is 11 and Y is 11; X is 11 and Y is 12; X is 11 and Y is 13; X is 11 and Y is 14; X is 11 and Y is 15; X is 11 and Y is 16; X is 11 and Y is 17; X is 11 and Y is 18; X is 11 and Y is 19; X is 11 and Y is 20; X is 11 and Y is 21; X is 11 and Y is 22; X is 11 and Y is 23; X is 11 and Y is 24; X is 11 and Y is 25; X is 11 and Y is 26; X is 11 and Y is 27; X is 11 and Y is 28; X is 11 and Y is 29; X is 11 and Y is 30; X is 11 and Y is 31; X is 11 and Y is 32; X is 11 and Y is 33; X is 11 and Y is 34; X is 11 and Y is 35; X is 11 and Y is 36; X is 11 and Y is 37; X is 11 and Y is 38; X is 11 and Y is 39; X is 11 and Y is 40; X is 11 and Y is 41; X is 11 and Y is 42; X is 11 and Y is 43; X is 11 and Y is 44; X is 11 and Y is 45; X is 11 and Y is 46; X is 11 and Y is 47; X is 11 and Y is 48; X is 11 and Y is 49; X is 11 and Y is 50; X is 11 and Y is 51; X is 11 and Y is 52; X is 11 and Y is 53; X is 11 and Y is 54; X is 11 and Y is 55; X is 11 and Y is 56; X is 11 and Y is 57; X is 11 and Y is 58; X is 11 and Y is 59; X is 11 and Y is 60; X is 11 and Y is 61; X is 11 and Y is 62; X is 11 and Y is 63; X is 11 and Y is 64; X is 11 and Y is 65; X is 11 and Y is 66; X is 11 and Y is 67; X is 11 and Y is 68; X is 11 and Y is 69; X is 11 and Y is 70; X is 11 and Y is 71; X is 11 and Y is 72; X is 11 and Y is 73; X is 11 and Y is 74; X is 11 and Y is 75; X is 11 and Y is 76; X is 11 and Y is 77; X is 11 and Y is 78; X is 11 and Y is 79; X is 11 and Y is 80; X is 11 and Y is 81; X is 11 and Y is 82; X is 11 and Y is 83; X is 11 and Y is 84; X is 11 and Y is 85; X is 11 and Y is 86; X is 11 and Y is 87; X is 11 and Y is 88; X is 11 and Y is 89; X is 11 and Y is 90; X is 11 and Y is 91; X is 11 and Y is 92; X is 11 and Y is 93; X is 11 and Y is 94; X is 11 and Y is 95; X is 11 and Y is 96; X is 11 and Y is 97; X is 11 and Y is 98; X is 11 and Y is 99; X is 11 and Y is 100; X is 11 and Y is 101; X is 11 and Y is 102; X is 11 and Y is 103; X is 11 and Y is 104; X is 11 and Y is 105; X is 11 and Y is 106; X is 11 and Y is 107; X is 11 and Y is 108; X is 11 and Y is 109; X is 11 and Y is 110; X is 11 and Y is 111; X is 11 and Y is 112; X is 11 and Y is 113; X is 11 and Y is 114; X is 11 and Y is 115; X is 11 and Y is 116; X is 11 and Y is 117; X is 11 and Y is 118; X is 11 and Y is 119; X is 11 and Y is 120; X is 11 and Y is 121; X is 11 and Y is 122; X is 11 and Y is 123; X is 11 and Y is 124; X is 11 and Y is 125; X is 11 and Y is 126; X is 11 and Y is 127; X is 11 and Y is 128; X is 11 and Y is 129; X is 11 and Y is 130; X is 11 and Y is 131; X is 11 and Y is 132; X is 11 and Y is 133; X is 11 and Y is 134; X is 11 and Y is 135; X is 11 and Y is 136; X is 11 and Y is 137; X is 11 and Y is 138; X is 11 and Y is 139; X is 11 and Y is 140; X is 11 and Y is 141; X is 11 and Y is 142; X is 11 and Y is 143; X is 11 and Y is 144; X is 11 and Y is 145; X is 11 and Y is 146; X is 11 and Y is 147; X is 11 and Y is 148; X is 11 and Y is 149; X is 11 and Y is 150; X is 11 and Y is 151; X is 11 and Y is 152; X is 11 and Y is 153; X is 11 and Y is 154; X is 11 and Y is 155; X is 11 and Y is 156; X is 11 and Y is 157; X is 11 and Y is 158; X is 11 and Y is 159; X is 11 and Y is 160; X is 11 and Y is 161; X is 11 and Y is 162; X is 11 and Y is 163; X is 11 and Y is 164; X is 11 and Y is 165; X is 11 and Y is 166; X is 11 and Y is 167; X is 11 and Y is 168; X is 11 and Y is 169; X is 11 and Y is 170; X is 11 and Y is 171; X is 11 and Y is 172; X is 11 and Y is 173; X is 11 and Y is 174; X is 11 and Y is 175; X is 11 and Y is 176; X is 11 and Y is 177; X is 11 and Y is 178; X is 11 and Y is 179; X is 11 and Y is 180; X is 11 and Y is 181; X is 11 and Y is 182; X is 11 and Y is 183; X is 11 and Y is 184; X is 11 and Y is 185; X is 11 and Y is 186;

X is 12 and Y is 1; X is 12 and Y is 2; X is 12 and Y is 3; X is 12 and Y is 4; X is 12 and Y is 5; X is 12 and Y is 6; X is 12 and Y is 7; X is 12 and Y is 8; X is 12 and Y is 9; X is 12 and Y is 10; X is 12 and Y is 11; X is 12 and Y is 12 and X is 12 and Y is 13; X is 12 and Y is 14; X is 12 and Y is 15; X is 12 and Y is 16; X is 12 and Y is 17; X is 12 and Y is 18; X is 12 and Y is 19; X is 12 and Y is 20; X is 12 and Y is 21; X is 12 and Y is 22; X is 12 and Y is 23; X is 12 and Y is 24; X is 12 and Y is 25; X is 12 and Y is 26; X is 12 and Y is 27; X is 12 and Y is 28; X is 12 and Y is 29; X is 12 and Y is 30; X is 12 and Y is 31; X is 12 and Y is 32; X is 12 and Y is 33; X is 12 and Y is 34; X is 12 and Y is 35; X is 12 and Y is 36; X is 12 and Y is 37; X is 12 and Y is 38; X is 12 and Y is 39; X is 12 and Y is 40; X is 12 and Y is 41; X is 12 and Y is 42; X is 12 and Y is 43; X is 12 and Y is 44; X is 12 and Y is 45; X is 12 and Y is 46; X is 12 and Y is 47; X is 12 and Y is 48; X is 12 and Y is 49; X is 12 and Y is 50; X is 12 and Y is 51; X is 12 and Y is 52; X is 12 and Y is 53; X is 12 and Y is 54; X is 12 and Y is 55; X is 12 and Y is 56; X is 12 and Y is 57; X is 12 and Y is 58; X is 12 and Y is 59; X is 12 and Y is 60; X is 12 and Y is 61; X is 12 and Y is 62; X is 12 and Y is 63; X is 12 and Y is 64; X is 12 and Y is 65; X is 12 and Y is 66; X is 12 and Y is 67; X is 12 and Y is 68; X is 12 and Y is 69; X is 12 and Y is 70; X is 12 and Y is 71; X is 12 and Y is 77; X is 12 and Y is 73; X is 12 and Y is 74; X is 12 and Y is 75; X is 12 and Y is 76; X is 12 and Y is 77; X is 12 and Y is 78; X is 12 and Y is 79; X is 12 and Y is 80; X is 12 and Y is 81; X is 12 and Y is 82; X is 12 and Y is 83; X is 12 and Y is 84; X is 12 and Y is 85; X is 12 and Y is 86; X is 12 and Y is 87; X is 12 and Y is 88; X is 12 and Y is 89; X is 12 and Y is 90; X is 12 and Y is 91; X is 12 and Y is 92; X is 12 and Y is 93; X is 12 and Y is 94; X is 12 and Y is 95; X is 12 and Y is 96; X is 12 and Y is 97; X is 12 and Y is 98; X is 12 and Y is 99; X is 12 and Y is 100; X is 12 and Y is 101; X is 12 and Y is 102; X is 12 and Y is 103; X is 12 and Y is 104; X is 12 and Y is 105; X is 12 and Y is 106; X is 12 and Y is 107; X is 12 and Y is 108; X is 12 and Y is 109; X is 12 and Y is 110; X is 12 and Y is 111; X is 12 and Y is 112; X is 12 and Y is 113; X is 12 and Y is 114; X is 12 and Y is 115; X is 12 and Y is 116; X is 12 and Y is 117; X is 12 and Y is 118; X is 12 and Y is 119; X is 12 and Y is 120; X is 12 and Y is 121; X is 12 and Y is 122; X is 12 and Y is 123; X is 12 and Y is 124; X is 12 and Y is 125; X is 12 and Y is 126; X is 12 and Y is 127; X is 12 and Y is 128; X is 12 and Y is 129; X is 12 and Y is 130; X is 12 and Y is 131; X is 12 and Y is 132; X is 12 and Y is 133; X is 12 and Y is 134; X is 12 and Y is 135; X is 12 and Y is 136; X is 12 and Y is 137; X is 12 and Y is 138; X is 12 and Y is 139; X is 12 and Y is 140; X is 12 and Y is 141; X is 12 and Y is 142; X is 12 and Y is 143; X is 12 and Y is 144; X is 12 and Y is 145; X is 12 and Y is 146; X is 12 and Y is 147; X is 12 and Y is 148; X is 12 and Y is 149; X is 12 and Y is 150; X is 12 and Y is 151; X is 12 and Y is 152; X is 12 and Y is 153; X is 12 and Y is 154; X is 12 and Y is 155; X is 12 and Y is 156; X is 12 and Y is 157; X is 12 and Y is 158; X is 12 and Y is 159; X is 12 and Y is 160; X is 12 and Y is 161; X is 12 and Y is 162; X is 12 and Y is 163; X is 12 and Y is 164; X is 12 and Y is 165; X is 12 and Y is 166; X is 12 and Y is 167; X is 12 and Y is 168; X is 12 and Y is 169; X is 12 and Y is 170; X is 12 and Y is 171; X is 12 and Y is 172; X is 12 and Y is 173; X is 12 and Y is 174; X is 12 and Y is 175; X is 12 and Y is 176; X is 12 and Y is 177; X is 12 and Y is 178; X is 12 and Y is 179; X is 12 and Y is 180; X is 12 and Y is 181; X is 12 and Y is 182; X is 12 and Y is 183; X is 12 and Y is 184; X is 12 and Y is 185; or X is 12 and Y is 186.

In one embodiment, X is 2 and Y is 5. In another embodiment, X is 10 and Y is 164.

In one embodiment, the first binding domain binds to 4-1BB (CD137) and the second binding domain binds to OX40 (CD134), wherein, preferably, the binding agent comprises one or more CDRs or one or more variable domains of an antibody AB137_X, wherein X is selected from the group consisting of 1 to 12, as shown in Table 9, and one or more CDRs or one or more variable domains of an antibody AB134_Y, wherein Y is selected from the group consisting of 1 to 92, as shown in Table 8.

In various embodiments, X is 1 and Y is selected from the group consisting of 1 to 92; X is 2 and Y is selected from the group consisting of 1 to 92; X is 3 and Y is selected from the group consisting of 1 to 92; X is 4 and Y is selected from the group consisting of 1 to 92; X is 5 and Y is selected from the group consisting of 1 to 92; X is 6 and Y is selected from the group consisting of 1 to 92; X is 7 and Y is selected from the group consisting of 1 to 92; X is 8 and Y is selected from the group consisting of 1 to 92; X is 9 and Y is selected from the group consisting of 1 to 92; X is 10 and Y is selected from the group consisting of 1 to 92; X is 11 and Y is selected from the group consisting of 1 to 92; or X is 12 and Y is selected from the group consisting of 1 to 92.

In various embodiments,
X is 1 and Y is 1; X is 1 and Y is 2; X is 1 and Y is 3; X is 1 and Y is 4; X is 1 and Y is 5; X is 1 and Y is 6; X is 1 and Y is 7; X is 1 and Y is 8; X is 1 and Y is 9; X is 1 and Y is 10; X is 1 and Y is 11; X is 1 and Y is 12; X is 1 and Y is 13; X is 1 and Y is 14; X is 1 and Y is 15; X is 1 and Y is 16; X is 1 and Y is 17; X is 1 and Y is 18; X is 1 and Y is 19; X is 1 and Y is 20; X is 1 and Y is 21; X is 1 and Y is 22; X is 1 and Y is 23; X is 1 and Y is 24; X is 1 and Y is 25; X is 1 and Y is 26; X is 1 and Y is 27; X is 1 and Y is 28; X is 1 and Y is 29; X is 1 and Y is 30; X is 1 and Y is 31; X is 1 and Y is 32; X is 1 and Y is 33; X is 1 and Y is 34; X is 1 and Y is 35; X is 1 and Y is 36; X is 1 and Y is 37; X is 1 and Y is 38; X is 1 and Y is 39; X is 1 and Y is 40; X is 1 and Y is 41; X is 1 and Y is 42; X is 1 and Y is 43; X is 1 and Y is 44; X is 1 and Y is 45; X is 1 and Y is 46; X is 1 and Y is 47; X is 1 and Y is 48; X is 1 and Y is 49; X is 1 and Y is 50; X is 1 and Y is 51; X is 1 and Y is 52; X is 1 and Y is 53; X is 1 and Y is 54; X is 1 and Y is 55; X is 1 and Y is 56; X is 1 and Y is 57; X is 1 and Y is 58; X is 1 and Y is 59; X is 1 and Y is 60; X is 1 and Y is 61; X is 1 and Y is 62; X is 1 and is 63; X is 1 and Y is 64; X is 1 and Y is 65; X is 1 and Y is 66; X is 1 and Y is 67; X is 1 and Y is 68; X is 1 and Y is 69; X is 1 and Y is 70; X is 1 and Y is 71; X is 1 and Y is 72; X is 1 and Y is 73; X is 1 and Y is 74; X is 1 and Y is 75; X is 1 and Y is 76; X is 1 and Y is 77; X is 1 and Y is 78; X is 1 and Y is 79; X is 1 and Y is 80; X is 1 and Y is 81; X is 1 and Y is 82; X is 1 and Y is 83; X is 1 and Y is 84; X is 1 and Y is 85; X is 1 and Y is 86; X is 1 and Y is 87; X is 1 and Y is 88; X is 1 and Y is 89; X is 1 and Y is 90; X is 1 and Y is 91; X is 1 and Y is 92;

X is 2 and Y is 1; X is 2 and Y is 2; X is 2 and Y is 3; X is 2 and Y is 4; X is 2 and Y is 5; X is 2 and Y is 6; X is 2 and Y is 7; X is 2 and Y is 8; X is 2 and Y is 9; X is 2 and Y is 10; X is 2 and Y is 11; X is 2 and Y is 12; X is 2 and Y is 13; X is 2 and Y is 14; X is 2 and Y is 15; X is 2 and Y is 16; X is 2 and Y is 17; X is 2 and Y is 18; X is 2 and Y is 19; X is 2 and Y is 20; X is 2 and Y is 21; X is 2 and Y is 22; X is 2 and Y is 23; X is 2 and Y is 24; X is 2 and Y is 25; X is 2 and Y is 26; X is 2 and Y is 27; X is 2 and Y is 28; X is 2 and Y is 29; X is 2 and Y is 30; X is 2 and Y is 31; X is 2 and Y is 32; X is 2 and Y is 33; X is 2 and Y is 34; X is 2 and Y is 35; X is 2 and Y is 36; X is 2 and Y is 37; X is 2 and Y is 38; X is 2 and Y is 39; X is 2 and Y is 40; X is 2 and Y is 41; X is 2 and Y is 42; X is 2 and Y is 43; X is 2 and Y is 44; X is 2 and Y is 45; X is 2 and Y is 46; X is 2 and Y is 47; X is 2 and Y is 48; X is 2 and Y is 49; X is 2 and Y is 50; X is 2 and Y is 51; X is 2 and Y is 52; X is 2 and Y is 53; X is 2 and Y is 54; X is 2 and Y is 55; X is 2 and Y is 56; X is 2 and Y is 57; X is 2 and Y is 58; X is 2 and Y is 59; X is 2 and Y is 60; X is 2 and Y is 61; X is 2 and Y is 62; X is 2 and Y is 63; X is 2 and Y is 64; X is 2 and Y is 65; X is 2 and Y is 66; X is 2 and Y is 67; X is 2 and Y is 68; X is 2 and Y is 69; X is 2 and Y is 70; X is 2 and Y is 71; X is 2 and Y is 72; X is 2 and Y is 73; X is 2 and Y is 74; X is 2 and Y is 75; X is 2 and Y is 76; X is 2 and Y is 77; X is 2 and Y is 78; X is 2 and Y is 79; X is 2 and Y is 80; X is 2 and Y is 81; X is 2 and Y is 82; X is 2 and Y is 83; X is 2 and Y is 84; X is 2 and Y is 85; X is 2 and Y is 86; X is 2 and Y is 87; X is 2 and Y is 88; X is 2 and Y is 89; X is 2 and Y is 90; X is 2 and Y is 91; X is 2 and Y is 92;

X is 3 and Y is 1; X is 3 and Y is 2; X is 3 and Y is 3; X is 3 and Y is 4; X is 3 and Y is 5; X is 3 and Y is 6; X is 3 and Y is 7; X is 3 and Y is 8; X is 3 and Y is 9; X is 3 and Y is 10; X is 3 and Y is 11; X is 3 and Y is 12; X is 3 and Y is 13; X is 3 and Y is 14; X is 3 and Y is 15; X is 3 and Y is 16; X is 3 and Y is 17; X is 3 and Y is 18; X is 3 and Y is 19; X is 3 and Y is 20; X is 3 and Y is 21; X is 3 and Y is 22; X is 3 and Y is 23; X is 3 and Y is 24; X is 3 and Y is 25; X is 3 and Y is 26; X is 3 and Y is 27; X is 3 and Y is 28; X is 3 and Y is 29; X is 3 and Y is 30; X is 3 and Y is 31; X is 3 and Y is 32; X is 3 and Y is 33; X is 3 and Y is 34; X is 3 and Y is 35; X is 3 and Y is 36; X is 3 and Y is 37; X is 3 and is 38; X is 3 and Y is 39; X is 3 and Y is 40; X is 3 and Y is 41; X is 3 and Y is 42; X is 3 and Y is 43; X is 3 and Y is 44; X is 3 and Y is 45; X is 3 and Y is 46; X is 3 and Y is 47; X is 3 and Y is 48; X is 3 and Y is 49; X is 3 and Y is 50; X is 3 and Y is 51; X is 3 and Y is 52; X is 3 and Y is 53; X is 3 and Y is 54; X is 3 and Y is 55; X is 3 and Y is 56; X is 3 and Y is 57; X is 3 and Y is 58; X is 3 and Y is 59; X is 3 and Y is 60; X is 3 and Y is 61; X is 3 and Y is 62; X is 3 and Y is 63; X is 3 and Y is 64; X is 3 and Y is 65; X is 3 and Y is 66; X is 3 and Y is 67; X is 3 and Y is 68; X is 3 and Y is 69; X is 3 and Y is 70; X is 3 and Y is 71; X is 3 and Y is 72; X is 3 and Y is 73; X is 3 and Y is 74; X is 3 and Y is 75; X is 3 and Y is 76; X is 3 and Y is 77; X is 3 and Y is 78; X is 3 and Y is 79; X is 3 and Y is 80; X is 3 and Y is 81; X is 3 and Y is 82; X is 3 and Y is 83; X is 3 and Y is 84; X is 3 and Y is 85; X is 3 and Y is 86; X is 3 and Y is 87; X is 3 and Y is 88; X is 3 and Y is 89; X is 3 and Y is 90; X is 3 and Y is 91; X is 3 and Y is 92;

X is 4 and Y is 1; X is 4 and Y is 2; X is 4 and Y is 3; X is 4 and Y is 4; X is 4 and Y is 5; X is 4 and Y is 6; X is 4 and Y is 7; X is 4 and Y is 8; X is 4 and is 9; X is 4 and Y is 10; X is 4 and Y is 11; X is 4 and Y is 12; X is 4 and Y is 13; X is 4 and Y is 14; X is 4 and Y is 15; X is 4 and Y is 16; X is 4 and Y is 17; X is 4 and Y is 18; X is 4 and Y is 19; X is 4 and Y is 20; X is 4 and Y is 11; X is 4 and Y is 22; X is 4 and Y is 23; X is 4 and Y is 24; X is 4 awl Y is 25; X is 4 and Y is 26; X is 4 and Y is 27; X is 4 and Y is 28; X is 4 and Y is 29; X is 4 and Y is 30; X is 4 and Y is 31; X is 4 and Y is 32; X is 4 and Y is 33; X is 4 and Y is 34; X is 4 and Y is 35; X is 4 and Y is 36; X is 4 and Y is 37; X is 4 and Y is 38; X is 4 and Y is 39; X is 4 and Y is 40; X is 4 and Y is 41; X is 4 and Y is 42; X is 4 and Y is 43; X is 4 and Y is 44; X is 4 and Y is 45; X is 4 and Y is 46; X is 4 and Y is 47; X is 4 and Y is 48; X is 4 and Y is 49; X is 4 and Y is 50; X is 4 and Y is 51; X is 4 and Y is 52; X is 4 and Y is 53; X is 4 and Y is 54; X is 4 and Y is 55; X is 4 and Y is 56; X is 4 and Y is 57; X is 4 and Y is 58; X is 4 and Y is 59; X is 4 and Y is 60; X is 4 and Y is 61; X is 4 and Y is 62; X is 4 and Y is 63; X is 4 and Y is 64; X is 4 and Y is 65; X is 4 and Y is 66; X is 4 and Y is 67; X is 4 and Y is 68; X is 4 and Y is 69; X is 4 and Y is 70; X is 4 and Y is 71; X is 4 and Y is 72; X is 4 and Y is 73; X is 4 and Y is 74; X is 4 and Y is 75; X is 4 and Y is 76; X is 4 and Y is 77; X is 4 and Y is 78; X is 4 and Y is 79; X is 4 and Y is 80; X is 4 and Y is 81; X is 4 and Y is 82; X is 4 and Y is 83; X is 4 and Y is 84; X is 4 and Y is 85; X is 4 and Y is 86; X is 4 and Y is 87; X is 4 and Y is 88; X is 4 and Y is 89; X is 4 and Y is 90; X is 4 and Y is 91; X is 4 and Y is 92;

X is 5 and Y is 1; X is 5 and Y is 7; X is 5 and Y is 3; X is 5 and Y is 4; X is 5 and Y is 5; X is 5 and Y is 6; X is 5 and Y is 7; X is 5 and Y is 8; X is 5 and Y is 9; X is 5 and Y is 10; X is 5 and Y is 11; X is 5 and Y is 12; X is 5 and Y is 13; X is 5 and Y is 14; X is 5 and Y is 15; X is 5 and Y is 16; X is 5 and Y is 17; X is 5 and Y is 18; X is 5 and Y is 19; X is 5 and Y is 20; X is 5 and Y is 21; X is 5 and Y is 22; X is 5 and Y is 23; X is 5 and Y is 24; X is 5 and Y is 25; X is 5 and Y is 26; X is 5 and Y is 27; X is 5 and Y is 28; X is 5 and Y is 29; X is 5 and Y is 30; X is 5 and Y is 31; X is 5 and Y is 32; X is 5 and Y is 33; X is 5 and Y is 34; X is 5 and Y is 35; X is 5 and Y is 36; X is 5 and Y is 37; X is 5 and Y is 38; X is 5 and Y is 39; X is 5 and Y is 40; X is 5 and Y is 41; X is 5 and Y is 42; X is 5 and Y is 43; X is 5 and Y is 44; X is 5 and Y is 45; X is 5 and Y is 46; X is 5 and Y is 47; X is 5 and Y is 48; X is 5 and Y is 49; X is 5 and Y is 50; X is 5 and Y is 51; X is 5 and Y is 52; X is 5 and Y is 53; X is 5 and Y is 54; X is 5 and Y is 55; X is 5 and Y is 56; X is 5 and Y is 57; X is 5 and Y is 58; X is 5 and Y is 59; X is 5 and Y is 60; X is 5 and Y is 61; X is 5 and Y is 62; X is 5 and Y is 63; X is 5 and Y is 64; X is 5 and Y is 65; X is 5 and Y is 66; X is 5 and Y is 67; X is 5 and Y is 68; X is 5 and Y is 69; X is 5 and Y is 70; X is 5 and Y is 71; X is 5 and Y is 72; X is 5 and Y is 73; X is 5 and Y is 74; X is 5 and Y is 75; X is 5 and Y is 76; X is 5 and Y is 77; X is 5 and Y is 78; X is 5 and Y is 79; X is 5 and Y is 80; X is 5 and Y is 81; X is 5 and Y is 82; X is 5 and Y is 83; X is 5 and Y is 84; X is 5 and Y is 85; X is 5 and Y is 86; X is 5 and Y is 87; X is 5 and Y is 88; X is 5 and Y is 89; X is 5 and Y is 90; X is 5 and Y is 91; X is 5 and Y is 92;

X is 6 and Y is 1; X is 6 and Y is 2; X is 6 and Y is 3; X is 6 and Y is 4; X is 6 and Y is 5; X is 6 and Y is 6; X is 6 and Y is 7; X is 6 and Y is 8; X is 6 and Y is 9; X is 6 and Y is 10; X is 6 and Y is 11; X is 6 and Y is 12; X is 6 and Y is 13; X is 6 and Y is 14; X is 6 and Y is 15; X is 6 and Y is 16; X is 6 and Y is 17; X is 6 and Y is 18; X is 6 and Y is 19; X is 6 and Y is 20; X is 6 and Y is 21; X is 6 and Y is 22; X is 6 and Y is 23; X is 6 and Y is 24; X is 6 and Y is 25; X is 6 and Y is 26; X is 6 and Y is 27; X is 6 and Y is 28; X is 6 and Y is 29; X is 6 and Y is 30; X is 6 and Y is 31; X is 6 and Y is 32; X is 6 and Y is 33; X is 6 and Y is 34; X is 6 and Y is 35; X is 6 and Y is 36; X is 6 and Y is 37; X is 6 and Y is 38; X is 6 and Y is 39; X is 6 and Y is 40; X is 6 and Y is 41; X is 6 and Y is 42; X is 6 and Y is 43; X is 6 and Y is 44; X is 6 and Y is 45; X is 6 and Y is 46; X is 6 and Y is 47; X is 6 and Y is 48; X is 6 and Y is 49; X is 6 and Y is 50; X is 6 and Y is 51; X is 6 and Y is 52; X is 6 and Y is 53; X is 6 and Y is 54; X is 6 and Y is 55; X is 6 and Y is 56; X is 6 and Y is 57; X is 6 and Y is 58; X is 6 and Y is 59; X is 6 and Y is 60; X is 6 and Y is 61; X is 6 and Y is 62; X is 6 and Y is 63; X is 6 and Y is 64; X is 6 and Y is 65; X is 6 and Y is 66; X is 6 and Y is 67; X is 6 and Y is 68; X is 6 and Y is 69; X is 6 and Y is 70; X is 6 and Y is 71; X is 6 and Y is 72; X is 6 and Y is 73; X is 6 and Y is 74; X is 6 and Y is 75; X is 6 and Y is 76; X is 6 and Y is 77; X is 6 and Y is 78; X is 6 and Y is 79; X is 6 and Y is 80; X is 6 and Y is 81; X is 6 and Y is 82; X is 6 and Y is 83; X is 6 and Y is 84; X is 6 and Y is 85; X is 6 and Y is 86; X is 6 and Y is 87; X is 6 and Y is 88; X is 6 and Y is 89; X is 6 and Y is 90; X is 6 and Y is 91; X is 6 and Y is 92;

X is 7 and Y is 1; X is 7 and Y is 2; X is 7 and Y is 3; X is 7 and Y is 4; X is 7 and Y is 5; X is 7 and Y is 6; X is 7 and Y is 7; X is 7 and Y is 8; X is 7 and Y is 9; X is 7 and Y is 10; X is 7 and Y is 11; X is 7 and Y is 12; X is 7 and Y is 13; X is 7 and Y is 14; X is 7 and Y is 15; X is 7 and Y is 16; X is 7 and Y is 17; X is 7 and Y is 18; X is 7 and Y is 19; X is 7 and Y is 20; X is 7 and Y is 21; X is 7 and Y is 22; X is 7 and Y is 23; X is 7 and Y is 24; X is 7 and Y is 25; X is 7 and Y is 26; X is 7 and Y is 27; X is 7 and Y is 28; X is 7 and Y is 29; X is 7 and Y is 30; X is 7 and Y is 31; X is 7 and Y is 32; X is 7 and Y is 33; X is 7 and Y is 34; X is 7 and Y is 35; X is 7 and Y is 36; X is 7 and Y is 37; X is 7 and Y is 38; X is 7 and Y is 39; X is 7 and Y is 40; X is 7 and Y is 41; X is 7 and Y is 42; X is 7 and Y is 43; X is 7 and Y is 44; X is 7 and Y is 45; X is 7 and Y is 46; X is 7 and Y is 47; X is 7 and Y is 48; X is 7 and Y is 49; X is 7 and Y is 50; X is 7 and Y is 51; X is 7 and Y is 52; X is 7 and Y is 53; X is 7 and Y is 54; X is 7 and Y is 55; X is 7 and Y is 56; X is 7 and Y is 57; X is 7 and Y is 58; X is 7 and Y is 59; X is 7 and Y is 60; X is 7 and Y is 61; X is 7 and Y is 62; X is 7 and Y is 63; X is 7 and Y is 64; X is 7 and Y is 65; X is 7 and Y is 66; X is 7 and Y is 67; X is 7 and Y is 68; X is 7 and Y is 69; X is 7 and Y is 70; X is 7 and Y is 71; X is 7 and Y is 72; X is 7 and Y is 73; X is 7 and Y is 74; X is 7 and Y is 75; X is 7 and Y is 76; X is 7 and Y is 77; X is 7 and Y is 78; X is 7 and Y is 79; X is 7 and Y is 80; X is 7 and Y is 81; X is 7 and Y is 82; X is 7 and Y is 83; X is 7 and Y is 84; X is 7 and Y is 85; X is 7 and Y is 86; X is 7 and Y is 87; X is 7 and Y is 88; X is 7 and Y is 89; X is 7 and Y is 90; X is 7 and Y is 91; X is 7 and Y is 92;

X is 8 and Y is 1; X is 8 and Y is 2; X is 8 and Y is 3; X is 8 and Y is 4; X is 8 and Y is 5; X is 8 and Y is 6; X is 8 and Y is 7; X is 8 and Y is 8; X is 8 and Y is 9; X is 8 and Y is 10; X is 8 and Y is 11; X is 8 and Y is 12; X is 8 and Y is 13; X is 8 and Y is 14; X is 8 and Y is 15; X is 8 and Y is 16; X is 8 and Y is 17; X is 8 and Y is 18; X is 8 and Y is 19; X is 8 and Y is 20; X is 8 and Y is 21; X is 8 and Y is 22; X is 8 and Y is 23; X is 8 and Y is 24; X is 8 and Y is 25; X is 8 and Y is 26; X is 8 and Y is 27; X is 8 and Y is 28; X is 8 and Y is 29; X is 8 and Y is 30; X is 8 and Y is 31; X is 8 and Y is 32; X is 8 and Y is 33; X is 8 and Y is 34; X is 8 and Y is 35; X is 8 and Y is 36; X is 8 and Y is 37; X is 8 and Y is 38; X is 8 and Y is 39; X is 8 and Y is 40; X is 8 and Y is 41; X is 8 and Y is 42; X is 8 and Y is 43; X is 8 and Y is 44; X is 8 and Y is 45; X is 8 and Y is 46; X is 8 and Y is 47; X is 8 and Y is 48; X is 8 and Y is 49; X is 8 and Y is 50; X is 8 and Y is 51; X is 8 and Y is 52; X is 8 and Y is 53; X is 8 and Y is 54; X is 8 and Y is 55; X is 8 and Y is 56; X is 8 and Y is 57; X is 8 and Y is 58; X is 8 and Y is 59; X is 8 and Y is 60; X is 8 and Y is 61; X is 8 and Y is 62; X is 8 and Y is 63; X is 8 and Y is 64; X is 8 and Y is 65; X is 8 and Y is 66; X is 8 and Y is 67; X is 8 and Y is 68; X is 8 and Y is 69; X is 8 and Y is 70; X is 8 and Y is 71; X is 8 and Y is 72; X is 8 and Y is 73; X is 8 and Y is 74; X is 8 and Y is 75; X is 8 and Y is 76; X is 8 and Y is 77; X is 8 and Y is 78; X is 8 and Y is 79; X is 8 and Y is 80; X is 8 and Y is 81; X is 8 and Y is 82; X is 8 and Y is 83; X is 8 and Y is 84; X is 8 and Y is 85; X is 8 and Y is 86; X is 8 and Y is 87; X is 8 and Y is 88; X is 8 and Y is 89; X is 8 and Y is 90; X is 8 and Y is 91; X is 8 and Y is 92;

X is 9 and Y is 1; X is 9 and Y is 2; X is 9 and Y is 3; X is 9 and Y is 4; X is 9 and Y is 5; X is 9 and Y is 6; X is 9 and Y is 7; X is 9 and Y is 8; X is 9 and Y is 9; X is 9 and Y is 10; X is 9 and Y is 11; X is 9 and Y is 12; X is 9 and Y is 13; X is 9 and Y is 14; X is 9 and Y is 15; X is 9 and Y is 16; X is 9 and Y is 17; X is 9 and Y is 18; X is 9 and Y is 19; X is 9 and Y is 20; X is 9 and Y is 21; X is 9 and Y is 22; X is 9 and Y is 23; X is 9 and Y is 24; X is 9 and Y is 25; X is 9 and Y is 26; X is 9 and Y is 27; X is 9 and Y is 28; X is 9 and Y is 29; X is 9 and Y is 30; X is 9 and Y is 31; X is 9 and Y is 32; X is 9 and Y is 33; X is 9 and Y is 34; X is 9 and Y is 35; X is 9 and Y is 36; X is 9 and Y is 37; X is 9 and Y is 38; X is 9 and Y is 39; X is 9 and Y is 40; X is 9 and Y is 41; X is 9 and Y is 42; X is 9 and Y is 43; X is 9 and Y is 44; X is 9 and Y is 45; X is 9 and Y is 46; X is 9 and Y is 47; X is 9 and Y is 48; X is 9 and Y is 49; X is 9 and Y is 50; X is 9 and Y is 51; X is 9 and Y is 52; X is 9 and Y is 53; X is 9 and Y is 54; X is 9 and Y is 55; X is 9 and Y is 56; X is 9 and Y is 57; X is 9 and Y is 58; X is 9 and Y is 59; X is 9 and Y is 60; X is 9 and Y is 61; X is 9 and Y is 62; X is 9 and Y is 63; X is 9 and Y is 64; X is 9 and Y is 65; X is 9 and Y is 66; X is 9 and Y is 67; X is 9 and Y is 68; X is 9 and Y is 69; X is 9 and Y is 70; X is 9 and Y is 71; X is 9 and Y is 72; X is 9 and Y is 73; X is 9 and Y is 74; X is 9 and Y is 75; X is 9 and Y is 76; X is 9 and Y is 77; X is 9 and Y is 78; X is 9 and Y is 79; X is 9 and Y is 80; X is 9 and Y is 81; X is 9 and Y is 82; X is 9 and Y is 83; X is 9 and Y is 84; X is 9 and Y is 85; X is 9 and Y is 86; X is 9 and Y is 87; X is 9 and Y is 88; X is 9 and Y is 89; X is 9 and Y is 90; X is 9 and Y is 91; X is 9 and Y is 92;

X is 10 and Y is 1; X is 10 and Y is 2; X is 10 and Y is 3; X is 10 and Y is 4; X is 10 and Y is 5; X is 10 and Y is 6; X is 10 and Y is 7; X is 10 and Y is 8; X is 10 and Y is 9; X is 10 and Y is 10; X is 10 and Y is 11; X is 10 and Y is 12; X is 10 and Y is 13; X is 10 and Y is 14; X is 10 and Y is 15; X is 10 and Y is 16; X is 10 and Y is 17; X is 10 and Y is 18; X is 10 and Y is 19; X is 10 and Y is 20; X is 10 and Y is 21; X is 10 and Y is 22; X is 10 and Y is 23; X is 10 and Y is 24; X is 10 and Y is 25; X is 10 and Y is 26; X is 10 and Y is 27; X is 10 and Y is 28; X is 10 and Y is 29; X is 10 and Y is 30; X is 10 and Y is 31; X is 10 and Y is 32; X is 10 and Y is 33; X is 10 and Y is 34; X is 10 and Y is 35; X is 10 and Y is 36; X is 10 and Y is 37; X is 10 and Y is 38; X is 10 and Y is 39; X is 10 and Y is 40; X is 10 and Y is 41; X is 10 and Y is 42; X is 10 and Y is 43; X is 10 and Y is 44; X is 10 and Y is 45; X is 10 and Y is 46; X is 10 and Y is 47; X is 10 and Y is 48; X is 10 and Y is 49; X is 10 and Y is 50; X is 10 and Y is 51; X is 10 and Y is 52; X is 10 and Y is 53; X is 10 and Y is 54; X is 10 and Y is 55; X is 10 and Y is 56; X is 10 and Y is 57; X is 10 and Y is 58; X is 10 and Y is 59; X is 10 and Y is 60; X is 10 and Y is 61; X is 10 and Y is 62; X is 10 and Y is 63; X is 10 and Y is 64; X is 10 and Y is 65; X is 10 and Y is 66; X is 10 and Y is 67; X is 10 and Y is 68; X is 10 and Y is 69; X is 10 and Y is 70; X is 10 and Y is 71; X is 10 and Y is 72; X is 10 and Y is 73; X is 10 and Y is 74; X is 10 and Y is 75; X is 10 and Y is 76; X is 10 and Y is 77; X is 10 and Y is 78; X is 10 and Y is 79; X is 10 and Y is 80; X is 10 and Y is 81; X is 10 and Y is 82; X is 10 and Y is 83; X is 10 and Y is 84; X is 10 and Y is 85; X is 10 and Y is 86; X is 10 and Y is 87; X is 10 and Y is 88; X is 10 and Y is 89; X is 10 and Y is 90; X is 10 and Y is 91; X is 10 and Y is 92;

X is 11 and Y is 1; X is 11 and Y is 2; X is 11 and Y is 3; X is 11 and Y is 4; X is 11 and Y is 5; X is 11 and Y is 6; X is 11 and Y is 7; X is 11 and Y is 8; X is 11 and Y is 9; X is 11 and Y is 10; X is 11 and Y is 11; X is 11 and Y is 12; X is 11 and Y is 13; X is 11 and Y is 14; X is 11 and Y is 15; X is 11 and Y is 16; X is 11 and Y is 17; X is 11 and Y is 18; X is 11 and Y is 19; X is 11 and Y is 20; X is 11 and Y is 21; X is 11 and Y is 22; X is 11 and Y is 23; X is 11 and Y is 24; X is 11 and Y is 25; X is 11 and Y is 26; X is 11 and Y is 27; X is 11 and Y is 28; X is 11 and Y is 29; X is 11 and Y is 30; X is 11 and Y is 31; X is 11 and Y is 32; X is 11 and Y is 33; X is 11 and Y is 34; X is 11 and Y is 35; X is 11 and Y is 36; X is 11 and Y is 37; X is 11 and Y is 38; X is 11 and Y is 39; X is 11 and Y is 40; X is 11 and Y is 41; X is 11 and Y is 42; X is 11 and Y is 43; X is 11 and Y is 44; X is 11 and Y is 45; X is 11 and Y is 46; X is 11 and Y is 47; X is 11 and Y is 48; X is 11 and Y is 49; X is 11 and Y is 50; X is 11 and Y is 51; X is 11 and Y is 52; X is 11 and Y is 53; X is 11 and Y is 54; X is 11 and Y is 55; X is 11 and Y is 56; X is 11 and Y is 57; X is 11 and Y is 58; X is 11 and Y is 59; X is 11 and Y is 60; X is 11 and Y is 61; X is 11 and Y is 62; X is 11 and Y is 63; X is 11 and Y is 64; X is 11 and Y is 65; X is 11 and Y is 66; X is 11 and Y is 67; X is 11 and Y is 68; X is 11 and Y is 69; X is 11 and Y is 70; X is 11 and v is 71; iv is 11 and Y is 72; X is 11 and Y is 73; X is 11 and Y is 74; X is 11 and Y is 75; X is 11 and Y is 76; X is 11 and Y is 77; X is 11 and Y is 78; X is 11 and Y is 79; X is 11 and Y is 80; X is 11 and Y is 81; X is 11 and Y is 82; X is 11 and Y is 83; X is 11 and Y is 84; X is 11 and Y is 85; X is 11 and Y is 86; X is 11 and Y is 87; X is 11 and Y is 88; X is 11 and Y is 89; X is 11 and Y is 90; X is 11 and Y is 91; X is 11 and Y is 92; X is 12 and Y is 1; X is 12 and Y is 2; X is 12 and Y is 3; X is 12 and Y is 4; X is 12 and Y is 5; X is 12 and Y is 6; X is 12 and Y is 7; X is 12 and Y is 8; X is 12 and Y is 9; X is 12 and Y is 10; X is 12 and Y is 11; X is 12 and Y is 12; X is 12 and Y is 13; X is 12 and Y is 14; X is 12 and Y is 15; X is 12 and Y is 16; X is 12 and Y is 17; X is 12 and Y is 18; X is 12 and Y is 19; X is 12 and Y is 20; X is 12 and Y is 21; X is 12 and Y is 22; X is 12 and Y is 23; X is 12 and Y is 24; X is 12 and Y is 25; X is 12 and Y is 26; X is 12 and Y is 27; X is 12 and Y is 28; X is 12 and Y is 29; X is 12 and Y is 30; X is 12 and Y is 31; X is 12 and Y is 32; X is 12 and Y is 33; X is 12 and Y is 34; X is 12 and Y is 35; X is 12 and Y is 36; X is 12 and Y is 37; X is 12 and Y is 38; X is 12 and Y is 39; X is 12 and Y is 40; X is 12 and Y is 41; X is 12 and Y is 42; X is 12 and Y is 43; X is 12 and Y is 44; X is 12 and Y is 45; X is 12 and Y is 46; X is 12 and Y is 47; X is 12 and Y is 48; X is 12 and Y is 49; X is 12 and Y is 50; X is 12 and Y is 51; X is 12 and Y is 52; X is 12 and Y is 53; X is 12 and Y is 54; X is 12 and Y is 55; X is 12 and Y is 56; X is 12 and Y is 57; X is 12 and Y is 58; X is 12 and Y is 59; X is 12 and Y is 60; X is 12 and Y is 61; X is 12 and Y is 62; X is 12 and Y is 63; X is 12 and Y is 64; X is 12 and Y is 65; X is 12 and Y is 66; X is 12 and Y is 67; X is 12 and Y is 68; X is 12 and Y is 69; X is 12 and Y is 70; X is 12 and Y is 71; X is 12 and Y is 72; X is 12 and Y is 73; X is 12 and Y is 74; X is 12 and Y is 75; X is 12 and Y is 76; X is 12 and Y is 77; X is 12 and Y is 78; X is 12 and Y is 79; X is 12 and Y is 80; X is 12 and Y is 81; X is 12 and Y is 82; X is 12 and Y is 83; X is 12 and Y is 84; X is 12 and Y is 85; X is 12 and Y is 86; X is 12 and Y is 87; X is 12 and Y is 88; X is 12 and Y is 89; X is 12 and Y is 90; X is 12 and Y is 91; or X is 12 and Y is 92.

In one embodiment, X is 2 and Y is 3. In another embodiment, X is 12 and Y is 9.

In one embodiment, the first binding domain binds to OX40 (CD134) and the second binding domain binds to CD27, wherein, preferably; the binding agent comprises one or more CDRs or one or more variable domains of an antibody AB134_X, wherein X is selected from the group consisting of 1 to 92, as shown in Table 8, and one or more CDRs or one or more variable domains of an antibody AB27_Y, wherein Y is selected from the group consisting of 1 to 186, as shown in Table 7.

In various embodiments, X is 1 and Y is selected from the group consisting of 1 to 186; X is 2 and Y is selected from the group consisting of 1 to 186; X is 3 and Y is selected from the group consisting of 1 to 186; X is 4 and Y is selected from the group consisting of 1 to 186; X is 5 and Y is selected from the group consisting of 1 to 186; X is 6 and Y is selected from the group consisting of 1 to 186; X is 7 and Y is selected from the group consisting of 1 to 186; X is 8 and Y is selected from the group consisting of 1 to 186; X is 9 and Y is selected from the group consisting of 1 to 186; X is 10 and Y is selected from the group consisting of 1 to 186; X is 11 and Y is selected from the group consisting of 1 to 186; X is 12 and Y is selected from the group consisting of 1 to 186; X is 13 and Y is selected from the group consisting of 1 to 186; X is 14 and Y is selected from the group consisting of 1 to 186; X is 15 and Y is selected from the group consisting of 1 to 186; X is 16 and Y is selected from the group consisting of 1 to 186; X is 17 and Y is selected from the group consisting of 1 to 186; X is 18 and Y is selected from the group consisting of 1 to 186; X is 19 and Y is selected from the group consisting of 1 to 186; X is 20 and Y is selected from the group consisting of 1 to 186; X is 21 and Y is selected from the group consisting of 1 to 186; X is 22 and Y is selected from the group consisting of 1 to 186; X is 23 and Y is selected from the group consisting of 1 to 186; X is 24 and Y is selected from the group consisting of 1 to 186; X is 25 and Y is selected from the group consisting of 1 to 186; X is 26 and Y is selected from the group consisting of 1 to 186; X is 27 and Y is selected from the group consisting of 1 to 186; X is 28 and Y is selected from the group consisting of 1 to 186; X is 29 and Y is selected from the group consisting of 1 to 186; X is 30 and Y is selected from the group consisting of 1 to 186; X is 31 and Y is selected from the group consisting of 1 to 186; X is 32 and Y is selected from the group consisting of 1 to 186; X is 33 and Y is selected from the group consisting of 1 to 186; X is 34 and Y is selected from the group consisting of 1 to 186; X is 35 and Y is selected from the group consisting of 1 to 186; X is 36 and Y is selected from the group consisting of 1 to 186; X is 37 and Y is selected from the group consisting of 1 to 186; X is 38 and Y is selected from the group consisting of 1 to 186; X is 39 and Y is selected from the group consisting of 1 to 186; X is 40 and Y is selected from the group consisting of 1 to 186; X is 41 and Y is selected from the group consisting of 1 to 186; X is 42 and Y is selected from the group consisting of 1 to 186; X is 43 and Y is selected from the group consisting of 1 to 186; X is 44 and Y is selected from the group consisting of 1 to 186; X is 45 and Y is selected from the group consisting of 1 to 186; X is 46 and Y is selected from the group consisting of 1 to 186; X is 47 and Y is selected from the group consisting of 1 to 186; X is 48 and Y is selected from the group consisting of 1 to 186; X is 49 and Y is selected from the group consisting of 1 to 186; X is 50 and Y is selected from the group consisting of 1 to 186; X is 51 and Y is selected from the group consisting of 1 to 186; X is 52 and Y is selected from the group consisting of 1 to 186; X is 53 and Y is selected from the group consisting of 1 to 186; X is 54 and Y is selected from the group consisting of 1 to 186; X is 55 and Y is selected from the group consisting of 1 to 186; X is 56 and Y is selected from the group consisting of 1 to 186; X is 57 and Y is selected from the group consisting of 1 to 186; X is 58 and Y is selected from the group consisting of 1 to 186; X is 59 and Y is selected from the group consisting of 1 to 186; X is 60 and Y is selected from the group consisting of 1 to 186; X is 61 and Y is selected from the group consisting of 1 to 186; X is 62 and Y is selected from the group consisting of 1 to 186; X is 63 and Y is selected from the group consisting of 1 to 186; X is 64 and Y is selected from the group consisting of 1 to 186; X is 65 and Y is selected from the group consisting of 1 to 186; X is 66 and Y is selected from the group consisting of 1 to 186; X is 67 and Y is selected from the group consisting of 1 to 186; X is 68 and Y is selected from the group consisting of 1 to 186; X is 69 and Y is selected from the group consisting of 1 to 186; X is 70 and Y is selected from the group consisting of 1 to 186; X is 71 and Y is selected from the group consisting of 1 to 186; X is 72 and Y is selected from the group consisting of 1 to 186; X is 73 and Y is selected from the group consisting of 1 to 186; X is 74 and Y is selected from the group consisting of 1 to 186; X is 75 and Y is selected from the group consisting of 1 to 186; X is 76 and Y is selected from the group consisting of 1 to 186; X is 77 and Y is selected from the group consisting of 1 to 186; X is 78 and Y is selected from the group consisting of 1 to 186; X is 79 and Y is selected from the group consisting of 1 to 186; X is 80 and Y is selected from the group consisting of 1 to 186; X is 81 and Y is selected from the group consisting of 1 to 186; X is 82 and Y is selected from the group consisting of 1 to 186; X is 83 and Y is selected from the group consisting of 1 to 186; X is 84 and Y is selected from the group consisting of 1 to 186; X is 85 and Y is selected from the group consisting of 1 to 186; X is 86 and Y is selected from the group consisting of 1 to 186 X is 87 and Y is selected from the group consisting of 1 to 186; X is 88 and Y is selected from the group consisting of 1 to 186; X is 89 and Y is selected from the group consisting of 1 to 186; X is 90 and Y is selected from the group consisting of 1 to 186; X is 91 and Y is selected from the group consisting of 1 to 186; or X is 92 and Y is selected from the group consisting of 1 to 186.

In various embodiments,

X is 1 and Y is 1; X is 1 and Y is 2; X is 1 and Y is 3; X is 1 and Y is 4; X is 1 and Y is 5; X is 1 and Y is 6; X is 1 and Y is 7; X is 1 and Y is 8; X is 1 and Y is 9; X is 1 and Y is 10; X is 1 and Y is 11; X is 1 and Y is 12; X is 1 and Y is 13; X is 1 and Y is 14; X is 1 and Y is 15; X is 1 and Y is 16; X is 1 and Y is 17; X is 1 and Y is 18; X is 1 and Y is 19; X is 1 and Y is 20; X is 1 and Y is 21; X is 1 and Y is 22; X is 1 and Y is 23; X is 1 and Y is 24; X is 1 and Y is 25; X is 1 and Y is 26; X is 1 and Y is 27; X is 1 and Y is 28; X is 1 and Y is 29; X is 1 and Y is 30; X is 1 and Y is 31; X is 1 and Y is 32; X is 1 and Y is 33; X is 1 and Y is 34; X is 1 and Y is 35; X is 1 and Y is 36; X is 1 and Y is 37; X is 1 and Y is 38; X is 1 and Y is 39; X is 1 and Y is 40; X is 1 and Y is 41; X is 1 and Y is 42; X is 1 and Y is 43; X is 1 and Y is 44; X is 1 and Y is 45; X is 1 and Y is 46; X is 1 and Y is 47; X is 1 and Y is 48; X is 1 and Y is 49; X is 1 and Y is 50; X is 1 and Y is 51; X is 1 and Y is 52; X is 1 and Y is 53; X is 1 and Y is 54; X is 1 and Y is 55; X is 1 and Y is 56; X is 1 and Y is 57; X is 1 and Y is 58; X is 1 and Y is 59; X is 1 and Y is 60; X is 1 and Y is 61; X is 1 and Y is 62; X is 1 and Y is 63; X is 1 and Y is 64; X is 1 and Y is 65; X is 1 and Y is 66; X is 1 and Y is 67; X is 1 and Y is 68; X is 1 and Y is 69; X is 1 and Y is 70; X is 1 and Y is 71; X is 1 and Y is 72; X is 1 and Y is 73; X is 1 and Y is 74; X is 1 and Y is 75; X is 1 and Y is 76; X is 1 and Y is 77; X is 1 and Y is 78; X is 1 and Y is 79; X is 1 and Y is 80; X is 1 and Y is 81; X is 1 and Y is 82; X is 1 and Y is 83; X is 1 and Y is 84; X is 1 and Y is 85; X is 1 and Y is 86; X is 1 and Y is 87; X is 1 and Y is 88; X is 1 and Y is 89; X is 1 and Y is 90; X is 1 and Y is 91; X is 1 and Y is 92; X is 1 and Y is 93; X is 1 and Y is 94; X is 1 and Y is 95; X is 1 and Y is 96; X is 1 and Y is 97; X is 1 and Y is 98; X is 1 and Y is 99; X is 1 and Y is 100; X is 1 and Y is 101; X is 1 and Y is 102; X is 1 and Y is 103; X is 1 and Y is 104; X is 1 and Y is 105; X is 1 and Y is 106; X is 1 and Y is 107; X is 1 and Y is 108; X is 1 and Y is 109; X is 1 and Y is 110; X is 1 and Y is 111; X is 1 and Y is 112; X is 1 and Y is 113; X is 1 and Y is 114; X is 1 and Y is 115; X is 1 and Y is 116; X is 1 and Y is 117; X is 1 and Y is 118; X is 1 and Y is 119; X is 1 and Y is 120; X is 1 and Y is 121; X is 1 and Y is 122; X is 1 and Y is 123; X is 1 and Y is 124; X is 1 and Y is 125; X is 1 and Y is 126; X is 1 and Y is 127; X is 1 and Y is 128; X is 1 and Y is 129; X is 1 and Y is 130; X is 1 and Y is 131; X is 1 and Y is 132; X is 1 and Y is 133; X is 1 and Y is 134; X is 1 and Y is 135; X is 1 and Y is 136; X is 1 and Y is 137; X is 1 and Y is 138; X is 1 and Y is 139; X is 1 and Y is 140; X is 1 and Y is 141; X is 1 and Y is 142; X is 1 and Y is 143; X is 1 and Y is 144; X is 1 and Y is 145; X is 1 and Y is 146; X is 1 and Y is 147; X is 1 and Y is 148; X is 1 and Y is 149; X is 1 and Y is 150; X is 1 and Y is 151; X is 1 and Y is 152; X is 1 and Y is 153; X is 1 and Y is 154; X is 1 and Y is 155; X is 1 and Y is 156; X is 1 and Y is 157; X is 1 and Y is 158; X is 1 and Y is 159; X is 1 and Y is 160; X is 1 and Y is 161; X is 1 and Y is 162; X is 1 and Y is 163; X is 1 and Y is 164; X is 1 and Y is 165; X is 1 and Y is 166; X is 1 and Y is 167; X is 1 and Y is 168; X is 1 and Y is 169; X is 1 and Y is 170; X is 1 and Y is 171; X is 1 and Y is 172; X is 1 and Y is 173; X is 1 and Y is 174; X is 1 and Y is 175; X is 1 and Y is 176; X is 1 and Y is 177; X is 1 and Y is 178; X is 1 and Y is 179; X is 1 and Y is 180; X is 1 and Y is 181; X is 1 and Y is 182; X is 1 and Y is 183; X is 1 and Y is 184; X is 1 and Y is 185; X is 1 and Y is 186; X is 2 and Y is 1; X is 2 and Y is 2; X is 2 and Y is 3; X is 2 and Y is 4; X is 2 and Y is 5; X is 2 and Y is 6; X is 2 and Y is 7; X is 2 and Y is 8; X is 2 and Y is 9; X is 2 and Y is 10; X is 2 and Y is 11; X is 2 and Y is 12; X is 2 and Y is 13; X is 2 and Y is 14; X is 2 and Y is 15; X is 2 and Y is 16; X is 2 and Y is 17; X is 2 and Y is 18; X is 2 and Y is 19; X is 2 and Y is 20; X is 2 and Y is 21; X is 2 and Y is 22; X is 2 and Y is 23; X is 2 and Y is 24; X is 2 and Y is 25; X is 2 and Y is 26; X is 2 and Y is 27; X is 2 and Y is 28; X is 2 and Y is 29; X is 2 and Y is 30; X is 2 and Y is 31; X is 2 and Y is 32; X is 2 and Y is 33; X is 2 and Y is 34; X is 2 and Y is 35; X is 2 and Y is 36; X is 2 and Y is 37; X is 2 and Y is 38; X is 2 and Y is 39; X is 2 and Y is 40; X is 2 and Y is 41; X is 2 and Y is 42; X is 2 and Y is 43; X is 2 and Y is 44; X is 2 and Y is 45; X is 2 and Y is 46; X is 2 and Y is 47; X is 2 and Y is 48; X is 2 and Y is 49; X is 2 and Y is 50; X is 2 and Y is 51; X is 2 and Y is 52; X is 2 and Y is 53; X is 2 and Y is 54; X is 2 and Y is 55; X is 2 and Y is 56; X is 2 and Y is 57; X is 2 and Y is 58; X is 2 and Y is 59; X is 2 and Y is 60; X is 2 and Y is 61; X is 2 and Y is 62; X is 2 and Y is 63; X is 2 and Y is 64; X is 2 and Y is 65; X is 2 and Y is 66; X is 2 and Y is 67; X is 2 and Y is 68; X is 2 and Y is 69; X is 2 and Y is 70; X is 2 and Y is 71; X is 2 and Y is 72; X is 2 and Y is 73; X is 2 and Y is 74; X is 2 and Y is 75; X is 2 and Y is 76; X is 2 and Y is 77; X is 2 and Y is 78; X is 2 and Y is 79; X is 2 and Y is 80; X is 2 and Y is 81; X is 2 and Y is 82; X is 2 and Y is 83; X is 2 and Y is 84; X is 2 and Y is R5; X is 2 and Y is 86; X is 2 and Y is 87; X is 2 and Y is 88; X is 2 and Y is 89; X is 2 and Y is 90; X is 2 and Y is 91; X is 2 and Y is 92; X is 2 and Y is 93; X is 2 and Y is 94; X is 2 and Y is 95; X is 2 and Y is 96; X is 2 and Y is 97; X is 2 and Y is 98; X is 2 and Y is 99; X is 2 and Y is 100; X is 2 and Y is 101; X is 2 and Y is 102; X is 2 and Y is 103; X is 2 and Y is 104; X is 2 and Y is 105; X is 2 and Y is 106; X is 2 and Y is 107; X is 2 and Y is 108; X is 2 and Y is 109; X is 2 and Y is 110; X is 2 and Y is 111; X is 2 and Y is 112; X is 2 and Y is 113; X is 2 and Y is 114; X is 2 and Y is 115; X is 2 and Y is 116; X is 2 and Y is 117; X is 2 and Y is 118; X is 2 and Y is 119; X is 2 and Y is 120; X is 2 and Y is 121; X is 2 and Y is 122; X is 2 and Y is 123; X is 2 and Y is 124; X is 2 and Y is 125; X is 2 and Y is 126; X is 2 and Y is 127; X is 2 and Y is 128; X is 2 and Y is 129; X is 2 and Y is 130; X is 2 and Y is 131; X is 2 and Y is 132; X is 2 and Y is 133; X is 2 and Y is 134; X is 2 and Y is 135; X is 2 and Y is 136; X is 2 and Y is 137; X is 2 and Y is 138; X is 2 and Y is 139; X is 2 and Y is 140; X is 2 and Y is 141; X is 2 and Y is 142; X is 2 and Y is 143; X is 2 and Y is 144; X is 2 and Y is 145; X is 2 and Y is 146; X is 2 and Y is 147; X is 2 and Y is 148; X is 2 and Y is 149; X is 2 and Y is 150; X is 2 and Y is 151; X is 2 and Y is 152; X is 2 and Y is 153; X is 2 and Y is 154; X is 2 and Y is 155; X is 2 and Y is 156; X is 2 and Y is 157; X is 2 and Y is 158; X is 2 and Y is 159; X is 2 and Y is 160; X is 2 and Y is 161; X is 2 and Y is 162; X is 2 and Y is 163; X is 2 and Y is 164; X is 2 and Y is 165; X is 2 and Y is 166; X is 2 and Y is 167; X is 2 and Y is 168; X is 2 and Y is 169; X is 2 and Y is 170; X is 2 and Y is 171; X is 2 and Y is 172; X is 2 and Y is 173; X is 2 and Y is 174; X is 2 and Y is 175; X is 2 and Y is 176; X is 2 and Y is 177; X is 2 and Y is 178; X is 2 and Y is 179; X is 2 and Y is 180; X is 2 and Y is 181; X is 2 and Y is 182; X is 2 and Y is 183; X is 2 and Y is 184; X is 2 and Y is 185; X is 2 and Y is 186; X is 3 and Y is 1; X is 3 and Y is 2; X is 3 and Y is 3; X is 3 and Y is 4; X is 3 and Y is 5; X is 3 and Y is 6; X is 3 and Y is 7; X is 3 and Y is 8; X is 3 and Y is 9; X is 3 and Y is 10; X is 3 and Y is 11; X is 3 and Y is 12; X is 3 and Y is 13; X is 3 and Y is 14; X is 3 and Y is 15; X is 3 and Y is 16; X is 3 and Y is 17; X is 3 and Y is 18; X is 3 and Y is 19; X is 3 and Y is 20; X is 3 and Y is 21; X is 3 and Y is 22; X is 3 and Y is 23; X is 3 and Y is 24; X is 3 and Y is 25; X is 3 and Y is 26; X is 3 and Y is 27; X is 3 and Y is 28; X is 3 and Y is 29; X is 3 and Y is 30; X is 3 and Y is 31; X is 3 and Y is 32; X is 3 and Y is 33; X is 3 and Y is 34; X is 3 and Y is 35; X is 3 and Y is 36; X is 3 and Y is 37; X is 3 and Y is 38; X is 3 and Y is 39; X is 3 and Y is 40; X is 3 and Y is 41; X is 3 and Y is 42; X is 3 and Y is 43; X is 3 and Y is 44; X is 3 and Y is 45; X is 3 and Y is 46; X is 3 and Y is 47; X is 3 and Y is 48; X is 3 and Y is 49; X is 3 and Y is 50; X is 3 and Y is 51; X is 3 and Y is 52; X is 3 and Y is 53; X is 3 and Y is 54; X is 3 and Y is 55; X is 3 and Y is 56; X is 3 and Y is 57; X is 3 and Y is 58; X is 3 and Y is 59; X is 3 and Y is 60; X is 3 and Y is 61; X is 3 and Y is 62; X is 3 and Y is 63; X is 3 and Y is 64; X is 3 and Y is 65; X is 3 and Y is 66; X is 3 and Y is 67; X is 3 and Y is 68; X is 3 and Y is 69; X is 3 and Y is 70; X is 3 and Y is 71; X is 3 and Y is 72; X is 3 and Y is 73; X is 3 and Y is 74; X is 3 and Y is 75; X is 3 and Y is 76; X is 3 and Y is 77; X is 3 and Y is 78; X is 3 and Y is 79; X is 3 and Y is 80; X is 3 and Y is 81; X is 3 and Y is 82; X is 3 and Y is 83; X is 3 and Y is 84; X is 3 and Y is 85; X is 3 and Y is 86; X is 3 and Y is 87; X is 3 and Y is 88; X is 3 and Y is 89; X is 3 and Y is 90; X is 3 and Y is 91; X is 3 and Y is 92; X is 3 and Y is 93; X is 3 and Y is 94; X is 3 and Y is 95; X is 3 and Y is 96; X is 3 and Y is 97; X is 3 and Y is 98; X is 3 and Y is 99; X is 3 and Y is 100; X is 3 and Y is 101; X is 3 and Y is 102; X is 3 and Y is 103; X is 3 and Y is 104; X is 3 and Y is 105; X is 3 and Y is 106; X is 3 and Y is 107; X is 3 and Y is 108; X is 3 and Y is 109; X is 3 and Y is 110; X is 3 and Y is 111; X is 3 and Y is 112; X is 3 and Y is 113; X is 3 and Y is 114; X is 3 and Y is 115; X is 3 and Y is 116; X is 3 and Y is 117; X is 3 and Y is 118; X is 3 and Y is 119; X is 3 and Y is 120; X is 3 and Y is 121; X is 3 and Y is 122; X is 3 and Y is 123; X is 3 and Y is 124; X is 3 and Y is 125; X is 3 and Y is 126; X is 3 and Y is 127; X is 3 and Y is 128; X is 3 and Y is 129; X is 3 and Y is 130; X is 3 and Y is 131; X is 3 and Y is 132; X is 3 and Y is 133; X is 3 and Y is 134; X is 3 and Y is 135; X is 3 and Y is 136; X is 3 and Y is 137; X is 3 and Y is 138; X is 3 and Y is 139; X is 3 and Y is 140; X is 3 and Y is 141; X is 3 and Y is 142; X is 3 and Y is 143; X is 3 and Y is 144; X is 3 and Y is 145; X is 3 and Y is 146; X is 3 and Y is 147; X is 3 and Y is 148; X is 3 and Y is 149; X is 3 and Y is 150; X is 3 and Y is 151; X is 3 and Y is 152; X is 3 and Y is 153; X is 3 and Y is 154; X is 3 and Y is 155; X is 3 and Y is 156; X is 3 and Y is 157; is 3 and Y is 158; X is 3 and Y is 159; X is 3 and Y is 160; X is 3 and Y is 161; X is 3 and Y is 162; X is 3 and Y is 163; X is 3 and Y is 164; X is 3 and Y is 165; X is 3 and Y is 166; X is 3 and Y is 167; X is 3 and Y is 168; X is 3 and Y is 169; X is 3 and Y is 170; X is 3 and Y is 171; X is 3 and Y is 172; X is 3 and Y is 173; X is 3 and Y is 174; X is 3 and Y is 175; X is 3 and Y is 176; X is 3 and Y is 177; X is 3 and Y is 178; X is 3 and Y is 179; X is 3 and Y is 180; X is 3 and Y is 181; X is 3 and Y is 182; X is 3 and Y is 183; X is 3 and Y is 184; X is 3 and Y is 185; X is 3 and Y is 186; X is 4 and Y is 1; X is 4 and Y is 2; X is 4 and Y is 3; X is 4 and Y is 4; X is 4 and Y is 5; X is 4 and Y is 6; X is 4 and Y is 7; X is 4 and Y is 8; X is 4 and Y is 9; X is 4 and Y is 10; X is 4 and Y is 11; X is 4 and Y is 12; X is 4 and Y is 13; X is 4 and Y is 14; X is 4 and Y is 15; X is 4 and Y is 16; X is 4 and Y is 17; X is 4 and Y is 18; X is 4 and Y is 19; X is 4 and Y is 20; X is 4 and Y is 21; X is 4 and Y is 22; X is 4 and Y is 23; X is 4 and Y is 24; X is 4 and Y is 25; X is 4 and Y is 26; X is 4 and Y is 27; X is 4 and Y is 28; X is 4 and Y is 29; X is 4 and Y is 30; X is 4 and Y is 31; X is 4 and Y is 32; X is 4 and Y is 33; X is 4 and Y is 34; X is 4 and Y is 35; X is 4 and Y is 36; X is 4 and Y is 37; X is 4 and Y is 38; X is 4 and Y is 39; X is 4 and Y is 40; X is 4 and Y is 41; X is 4 and Y is 42; X is 4 and Y is 43; X is 4 and Y is 44; X is 4 and Y is 45; X is 4 and Y is 46; X is 4 and Y is 47; X is 4 and Y is 48; X is 4 and Y is 49; X is 4 and Y is 50; X is 4 and Y is 51; X is 4 and Y is 52; X is 4 and Y is 53; X is 4 and Y is 54; X is 4 and Y is 55; X is 4 and Y is 56; X is 4 and Y is 57; X is 4 and Y is 58; X is 4 and Y is 59; X is 4 and Y is 60; X is 4 and Y is 61; X is 4 and Y is 62; X is 4 and Y is 63; X is 4 and Y is 64; X is 4 and Y is 65; X is 4 and Y is 66; X is 4 and Y is 67; X is 4 and Y is 68; X is 4 and Y is 69; X is 4 and Y is 70; X is 4 and Y is 71; X is 4 and Y is 72; X is 4 and Y is 73; X is 4 and Y is 74; X is 4 and Y is 75; X is 4 and Y is 76; X is 4 and Y is 77; X is 4 and Y is 78; X is 4 and Y is 79; X is 4 and Y is 80; X is 4 and Y is 81; X is 4 and Y is 82; X is 4 and Y is 83; X is 4 and Y is 84; X is 4 and Y is 85; X is 4 and Y is 86; X is 4 and Y is 87; X is 4 and Y is 88; X is 4 and Y is 89; X is 4 and Y is 90; X is 4 and Y is 91; X is 4 and Y is 92; X is 4 and Y is 93; X is 4 and Y is 94; X is 4 and Y is 95; X is 4 and Y is 96; X is 4 and Y is 97; X is 4 and Y is 98; X is 4 and Y is 99; X is 4 and Y is 100; X is 4 and Y is 101; X is 4 and Y is 102; X is 4 and Y is 103; X is 4 and Y is 104; X is 4 and Y is 105; X is 4 and Y is 106; X is 4 and Y is 107; X is 4 and Y is 108; X is 4 and Y is 109; X is 4 and Y is 110; X is 4 and Y is 111; X is 4 and Y is 112; X is 4 and Y is 113; X is 4 and Y is 114; X is 4 and Y is 115; X is 4 and Y is 116; X is 4 and Y is 117; X is 4 and Y is 118; X is 4 and Y is 119; X is 4 and Y is 120; X is 4 and Y is 121; X is 4 and Y is 122; X is 4 and Y is 123; X is 4 and Y is 124; X is 4 and Y is 125; X is 4 and Y is 126; X is 4 and Y is 127; X is 4 and Y is 128; X is 4 and Y is 129; X is 4 and Y is 130; X is 4 and Y is 131; X is 4 and Y is 132; X is 4 and Y is 133; X is 4 and Y is 134; X is 4 and Y is 135; X is 4 and Y is 136; X is 4 and Y is 137; X is 4 and Y is 138; X is 4 and Y is 139; X is 4 and Y is 140; X is 4 and Y is 141; X is 4 and Y is 142; X is 4 and Y is 143; X is 4 and Y is 144; X is 4 and Y is 145; X is 4 and Y is 146; X is 4 and Y is 147; X is 4 and Y is 148; X is 4 and Y is 149; X is 4 and Y is 150; X is 4 and Y is 151; X is 4 and Y is 152; X is 4 and Y is 153; X is 4 and Y is 154; X is 4 and Y is 155; X is 4 and Y is 156; X is 4 and Y is 157; X is 4 and Y is 158; X is 4 and Y is 159; X is 4 and Y is 160; X is 4 and Y is 161; X is 4 and Y is 162; X is 4 and Y is 163; X is 4 and Y is 164; X is 4 and Y is 165; X is 4 and Y is 166; X is 4 and Y is 167; X is 4 and Y is 168; X is 4 and Y is 169; X is 4 and Y is 170; X is 4 and Y is 171; X is 4 and Y is 172; X is 4 and Y is 173; X is 4 and Y is 174; X is 4 and Y is 175; X is 4 and Y is 176; X is 4 and Y is 177; X is 4 and Y is 178; X is 4 and Y is 179; X is 4 and Y is 180; X is 4 and Y is 181; X is 4 and Y is 182; X is 4 and Y is 183; X is 4 and Y is 184; X is 4 and Y is 185; X is 4 and Y is 186; X is 5 and Y is 1; X is 5 and Y is 2; X is 5 and Y is 3; X is 5 and Y is 4; X is 5 and Y is 5; X is 5 and Y is 6; X is 5 and Y is 7; X is 5 and Y is 8; X is 5 and Y is 9; X is 5 and Y is 10; X is 5 and Y is 11; X is 5 and Y is 12; X is 5 and Y is 13; X is 5 and Y is 14; X is 5 and Y is 15; X is 5 and Y is 16; X is 5 and Y is 17; X is 5 and Y is 18; X is 5 and Y is 19; X is 5 and Y is 20; X is 5 and Y is 21; X is 5 and Y is 22; X is 5 and Y is 23; X is 5 and Y is 24; X is 5 and Y is 25; X is 5 and Y is 26; X is 5 and Y is 27; X is 5 and Y is 28; X is 5 and Y is 29; X is 5 and Y is 30; X is 5 and Y is 31; X is 5 and Y is 32; X is 5 and Y is 33; X is 5 and Y is 34; X is 5 and Y is 35; X is 5 and Y is 36; X is 5 and Y is 37; X is 5 and Y is 38; X is 5 and Y is 39; X is 5 and Y is 40; X is 5 and Y is 41; X is 5 and Y is 42; X is 5 and Y is 43; X is 5 and Y is 44; X is 5 and Y is 45; X is 5 and Y is 46; X is 5 and Y is 47; X is 5 and Y is 48; X is 5 and Y is 49; X is 5 and Y is 50; X is 5 and Y is 51; X is 5 and Y is 52; X is 5 and Y is 53; X is 5 and Y is 54; X is 5 and Y is 55; X is 5 and Y is 56; X is 5 and Y is 57; X is 5 and Y is 58; X is 5 and Y is 59; X is 5 and Y is 60; X is 5 and Y is 61; X is 5 and Y is 62; X is 5 and Y is 63; X is 5 and Y is 64; X is 5 and Y is 65; X is 5 and Y is 66; X is 5 and Y is 67; X is 5 and Y is 68; X is 5 and Y is 69; X is 5 and Y is 70; X is 5 and Y is 71; X is 5 and Y is 72; X is 5 and Y is 73; X is 5 and Y is 74; X is 5 and Y is 75; X is 5 and Y is 76; X is 5 and Y is 77; X is 5 and Y is 78; X is 5 and Y is 79; X is 5 and Y is 80; X is 5 and Y is 81; X is 5 and Y is 82; X is 5 and Y is 83; X is 5 and Y is 84; X is 5 and Y is 85; X is 5 and Y is 86; X is 5 and Y is 87; X is 5 and Y is 88; X is 5 and Y is 89; X is 5 and Y is 90; X is 5 and Y is 91; X is 5 and Y is 92; X is 5 and Y is 93; X is 5 and Y is 94; X is 5 and Y is 95; X is 5 and Y is 96; X is 5 and Y is 97; X is 5 and Y is 98; X is 5 and Y is 99; X is 5 and Y is 10n; X is 5 and Y is 101; X is 5 and Y is 102; X is 5 and Y is 103; X is 5 and Y is 104; X is 5 and Y is 105; X is 5 and Y is 106; X is 5 and Y is 107; X is 5 and Y is 108; X is 5 and Y is 109; X is 5 and Y is 110; X is 5 and Y is 111; X is 5 and Y is 112; X is 5 and Y is 113; X is 5 and Y is 114; X is 5 and Y is 115; X is 5 and Y is 116; X is 5 and Y is 117; X is 5 and Y is 118; X is 5 and Y is 119; X is 5 and Y is 120; X is 5 and Y is 121; X is 5 and Y is 122; X is 5 and Y is 123; X is 5 and Y is 124; X is 5 and Y is 125; X is 5 and Y is 126; X is 5 and Y is 127; X is 5 and Y is 128; X is 5 and Y is 129; X is 5 and Y is 130; X is 5 and Y is 131; X is 5 and Y is 132; X is 5 and Y is 133; X is 5 and Y is 134; X is 5 and Y is 135; X is 5 and Y is 136; X is 5 and Y is 137; X is 5 and Y is 138; X is 5 and Y is 139; X is 5 and Y is 140; X is 5 and Y is 141; X is 5 and Y is 142; X is 5 and Y is 143; X is 5 and Y is 144; X is 5 and Y is 145; X is 5 and Y is 146; X is 5 and Y is 147; X is 5 and Y is 148; X is 5 and Y is 149; X is 5 and Y is 150; X is 5 and Y is 151; X is 5 and Y is 152; X is 5 and Y is 153; X is 5 and Y is 154; X is 5 and Y is 155; X is 5 and Y is 156; X is 5 and Y is 157; X is 5 and Y is 158; X is 5 and Y is 159; X is 5 and Y is 160; X is 5 and Y is 161; X is 5 and Y is 162; X is 5 and Y is 163; X is 5 and Y is 164; X is 5 and Y is 165; X is 5 and Y is 166; X is 5 and Y is 167; X is 5 and Y is 168; X is 5 and Y is 169; X is 5 and Y is 170; X is 5 and Y is 171; X is 5 and Y is 172; X is 5 and Y is 173; X is 5 and Y is 174; X is 5 and Y is 175; X is 5 and Y is 176; X is 5 and Y is 177; X is 5 and Y is 178; X is 5 and Y is 179; X is 5 and Y is 180; X is 5 and Y is 181; X is 5 and Y is 182; X is 5 and Y is 183; X is 5 and Y is 184; X is 5 and Y is 185; X is 5 and Y is 186; X is 6 and Y is 1; X is 6 and Y is 2; X is 6 and Y is 3; X is 6 and Y is 4; X is 6 and Y is 5; X is 6 and Y is 6; X is 6 and Y is 7; X is 6 and Y is 8; X is 6 and Y is 9; X is 6 and Y is 10; X is 6 and Y is 11; X is 6 and Y is 12; X is 6 and Y is 13; X is 6 and Y is 14; X is 6 and Y is 15; X is 6 and Y is 16; X is 6 and Y is 17; X is 6 and Y is 18; X is 6 and Y is 19; X is 6 and Y is 20; X is 6 and Y is 21; X is 6 and Y is 22; X is 6 and Y is 23; X is 6 and Y is 24; X is 6 and Y is 25; X is 6 and Y is 26; X is 6 and Y is 27; X is 6 and Y is 28; X is 6 and Y is 29; X is 6 and Y is 30; X is 6 and Y is 31; X is 6 and Y is 32; X is 6 and Y is 33; X is 6 and Y is 34; X is 6 and Y is 35; X is 6 and Y is 36; X is 6 and Y is 37; X is 6 and Y is 38; X is 6 and Y is 39; X is 6 and Y is 40; X is 6 and Y is 41; X is 6 and Y is 42; X is 6 and Y is 43; X is 6 and Y is 44; X is 6 and Y is 45; X is 6 and Y is 46; X is 6 and Y is 47; X is 6 and Y is 48; X is 6 and Y is 49; X is 6 and Y is 50; X is 6 and Y is 51; X is 6 and Y is 52; X is 6 and Y is 53; X is 6 and Y is 54; X is 6 and Y is 55; X is 6 and Y is 56; X is 6 and Y is 57; X is 6 and Y is 58; X is 6 and Y is 59; X is 6 and Y is 60; X is 6 and Y is 61; X is 6 and Y is 62; X is 6 and Y is 63; X is 6 and Y is 64; X is 6 and Y is 65; X is 6 and Y is 66; X is 6 and Y is 67; X is 6 and Y is 68; X is 6 and Y is 69; X is 6 and Y is 70; X is 6 and Y is 71; X is 6 and Y is 72; X is 6 and Y is 73; X is 6 and Y is 74; X is 6 and Y is 75; X is 6 and Y is 76; X is 6 and Y is 77; X is 6 and Y is 78; X is 6 and Y is 79; X is 6 and Y is 80; X is 6 and Y is 81; X is 6 and Y is 82; X is 6 and Y is 83; X is 6 and Y is 84; X is 6 and Y is 85; X is 6 and Y is 86; X is 6 and Y is 87; X is 6 and Y is 88; X is 6 and Y is 89; X is 6 and Y is 90; X is 6 and Y is 91; X is 6 and Y is 92; X is 6 and Y is 93; X is 6 and Y is 94; X is 6 and Y is 95; X is 6 and Y is 96; X is 6 and Y is 97; X is 6 and Y is 98; X is 6 and Y is 99; X is 6 and Y is 100; X is 6 and Y is 101; X is 6 and Y is 102; X is 6 and Y is 103; X is 6 and Y is 104; X is 6 and Y is 105; X is 6 and Y is 106; X is 6 and Y is 107; X is 6 and Y is 108; X is 6 and Y is 109; X is 6 and Y is 110; X is 6 and Y is 111; X is 6 and Y is 112; X is 6 and Y is 113; X is 6 and Y is 114; X is 6 and Y is 115; X is 6 and Y is 116; X is 6 and Y is 117; X is 6 and Y is 118; X is 6 and Y is 119; X is 6 and Y is 120; X is 6 and Y is 121; X is 6 and Y is 122; X is 6 and Y is 123; X is 6 and Y is 124; X is 6 and Y is 125; X is 6 and Y is 126; X is 6 and Y is 127; X is 6 and Y is 128; X is 6 and Y is 129; X is 6 and Y is 130; X is 6 and Y is 131; X is 6 and Y is 132; X is 6 and Y is 133; X is 6 and Y is 134; X is 6 and Y is 135; X is 6 and Y is 136; X is 6 and Y is 137; X is 6 and Y is 138; X is 6 and Y is 139; X is 6 and Y is 140; X is 6 and Y is 141; X is 6 and Y is 142; X is 6 and Y is 143; X is 6 and Y is 144; X is 6 and Y is 145; X is 6 and Y is 146; X is 6 and Y is 147; X is 6 and Y is 148; X is 6 and Y is 149; X is 6 and Y is 150; X is 6 and Y is 151; X is 6 and Y is 152; X is 6 and Y is 153; X is 6 and Y is 154; X is 6 and Y is 155; X is 6 and Y is 156; X is 6 and Y is 157; X is 6 and Y is 158; X is 6 and Y is 159; X is 6 and Y is 160; X is 6 and Y is 161; X is 6 and Y is 162; X is 6 and Y is 163; X is 6 and Y is 164; X is 6 and Y is 165; X is 6 and Y is 166; X is 6 and Y is 167; X is 6 and Y is 168; X is 6 and Y is 169; X is 6 and Y is 170; X is 6 and Y is 171; X is 6 and Y is 172; X is 6 and Y is 173; X is 6 and Y is 174; X is 6 and Y is 175; X is 6 and Y is 176; X is 6 and Y is 177; X is 6 and Y is 178; X is 6 and Y is 179; X is 6 and Y is 180; X is 6 and Y is 181; X is 6 and Y is 182; X is 6 and Y is 183; X is 6 and Y is 184; X is 6 and Y is 185; X is 6 and Y is 186; X is 7 and Y is 1; X is 7 and Y is 2; X is 7 and Y is 3; X is 7 and Y is 4; X is 7 and Y is 5; X is 7 and Y is 6; X is 7 and Y is 7; X is 7 and Y is 8; X is 7 and Y is 9; X is 7 and Y is 10; X is 7 and Y is 11; X is 7 and Y is 12; X is 7 and Y is 13; X is 7 and Y is 14; X is 7 and Y is 15; X is 7 and Y is 16; X is 7 and Y is 17; X is 7 and Y is 18; X is 7 and Y is 19; X is 7 and Y is 20; X is 7 and Y is 21; X is 7 and Y is 22; X is 7 and Y is 23; X is 7 and Y is 24; X is 7 and Y is 25; X is 7 and Y is 26; X is 7 and Y is 27; X is 7 and Y is 28; X is 7 and Y is 29; X is 7 and Y is 30; X is 7 and Y is 31; X is 7 and Y is 32; X is 7 and Y is 33; X is 7 and Y is 34; X is 7 and Y is 35; X is 7 and Y is 36; X is 7 and Y is 37; X is 7 and Y is 38; X is 7 and Y is 39; X is 7 and Y is 40; X is 7 and Y is 41; X is 7 and Y is 42; X is 7 and Y is 43; X is 7 and Y is 44; X is 7 and Y is 45; X is 7 and Y is 46; X is 7 and Y is 47; X is 7 and Y is 48; X is 7 and Y is 49; X is 7 and Y is 50; X is 7 and Y is 51; X is 7 and Y is 52; X is 7 and Y is 53; X is 7 and Y is 54; X is 7 and Y is 55; X is 7 and Y is 56; X is 7 and Y is 57; X is 7 and Y is 58; X is 7 and Y is 59; X is 7 and Y is 60; X is 7 and Y is 61; X is 7 and Y is 62; X is 7 and Y is 63; X is 7 and Y is 64; X is 7 and Y is 65; X is 7 and Y is 66; X is 7 and Y is 67; X is 7 and Y is 68; X is 7 and Y is 69; X is 7 and Y is 70; X is 7 and Y is 71; X is 7 and Y is 72; X is 7 and Y is 73; X is 7 and Y is 74; X is 7 and Y is 75; X is 7 and Y is 76; X is 7 and Y is 77; X is 7 and Y is 78; X is 7 and Y is 79; X is 7 and Y is 80; X is 7 and Y is 81; X is 7 and Y is 82; X is 7 and Y is 83; X is 7 and Y is 84; X is 7 and Y is 85; X is 7 and Y is 86; X is 7 and Y is 87; X is 7 and Y is 88; X is 7 and Y is 89; X is 7 and Y is 90; X is 7 and Y is 91; X is 7 and Y is 92; X is 7 and Y is 93; X is 7 and Y is 94; X is 7 and Y is 95; X is 7 and Y is 96; X is 7 and Y is 97; X is 7 and Y is 98; X is 7 and Y is 99; X is 7 and Y is 100; X is 7 and Y is 101; X is 7 and Y is 102; X is 7 and Y is 103; X is 7 and Y is 104; X is 7 and Y is 105; X is 7 and Y is 106; X is 7 and Y is 107; X is 7 and Y is 108; X is 7 and Y is 109; X is 7 and Y is 110; X is 7 and Y is 111; X is 7 and Y is 112; X is 7 and Y is 113; X is 7 and Y is 114; X is 7 and Y is 115; X is 7 and Y is 116; X is 7 and Y is 117; X is 7 and Y is 118; X is 7 and Y is 119; X is 7 and Y is 120; X is 7 and Y is 121; X is 7 and Y is 122; X is 7 and Y is 123; X is 7 and Y is 124; X is 7 and Y is 125; X is 7 and Y is 126; X is 7 and Y is 127; X is 7 and Y is 128; X is 7 and Y is 129; X is 7 and Y is 130; X is 7 and Y is 131; X is 7 and Y is 132; X is 7 and Y is 133; X is 7 and Y is 134; X is 7 and Y is 135; X is 7 and Y is 136; X is 7 and Y is 137; X is 7 and Y is 138; X is 7 and Y is 139; X is 7 and Y is 140; X is 7 and Y is 141; X is 7 and Y is 142; X is 7 and Y is 143; X is 7 and Y is 144; X is 7 and Y is 145; X is 7 and Y is 146; X is 7 and Y is 147; X is 7 and Y is 148; X is 7 and Y is 149; X is 7 and Y is 150; X is 7 and Y is 151; X is 7 and Y is 152; X is 7 and Y is 153; X is 7 and Y is 154; X is 7 and Y is 155; X is 7 and Y is 156; X is 7 and Y is 157; X is 7 and Y is 158; X is 7 and Y is 159; X is 7 and Y is 160; X is 7 and Y is 161; X is 7 and Y is 162; X is 7 and Y is 163; X is 7 and Y is 164; X is 7 and Y is 165; X is 7 and Y is 166; X is 7 and Y is 167; X is 7 and Y is 168; X is 7 and Y is 169; X is 7 and Y is 170; X is 7 and Y is 171; X is 7 and Y is 172; X is 7 and Y is 173; X is 7 and Y is 174; X is 7 and Y is 175; X is 7 and Y is 176; X is 7 and Y is 177; X is 7 and Y is 178; X is 7 and Y is 179; X is 7 and Y is 180; X is 7 and Y is 181; X is 7 and Y is 182; X is 7 and Y is 183; X is 7 and Y is 184; X is 7 and Y is 185; X is 7 and Y is 186; X is 8 and Y is 1; X is 8 and Y is 2; X is 8 and Y is 3; X is 8 and Y is 4; X is 8 and Y is 5; X is 8 and Y is 6; X is 8 and Y is 7; X is 8 and Y is 8; X is 8 and Y is 9; X is 8 and Y is 10; X is 8 and Y is 11; X is 8 and Y is 12; X is 8 and Y is 13; X is 8 and Y is 14; X is 8 and Y is 15; X is 8 and Y is 16; X is 8 and Y is 17; X is 8 and Y is 18; X is 8 and Y is 19; X is 8 and Y is 20; X is 8 and Y is 21; X is 8 and Y is 22; X is 8 and Y is 23; X is 8 and Y is 24; X is 8 and Y is 25; X is 8 and Y is 26; X is 8 and Y is 27; X is 8 and Y is 28; X is 8 and Y is 29; X is 8 and Y is 30; X is 8 and Y is 31; X is 8 and Y is 32; X is 8 and Y is 33; X is 8 and Y is 34; X is 8 and Y is 35; X is 8 and Y is 36; X is 8 and Y is 37; X is 8 and Y is 38; X is 8 and Y is 39; X is 8 and Y is 40; X is 8 and Y is 41; X is 8 and Y is 42; X is 8 and Y is 43; X is 8 and Y is 44; X is 8 and Y is 45; X is 8 and Y is 46; X is 8 and Y is 47; X is 8 and Y is 48; X is 8 and Y is 49; X is 8 and Y is 50; X is 8 and Y is 51; X is 8 and Y is 52; X is 8 and Y is 53; X is 8 and Y is 54; X is 8 and Y is 55; X is 8 and Y is 56; X is 8 and Y is 57; X is 8 and Y is 58; X is 8 and Y is 59; X is 8 and Y is 60; X is 8 and Y is 61; X is 8 and Y is 62; X is 8 and Y is 63; X is 8 and Y is 64; X is 8 and Y is 65; X is 8 and Y is 66; X is 8 and Y is 67; X is 8 and Y is 68; X is 8 and Y is 69; X is 8 and Y is 70; X is 8 and Y is 71; X is 8 and Y is 72; X is 8 and Y is 73; X is 8 and Y is 74; X is 8 and Y is 75; X is 8 and Y is 76; X is 8 and Y is 77; X is 8 and Y is 78; X is 8 and Y is 79; X is 8 and Y is 80; X is 8 and Y is 81; X is 8 and Y is 82; X is 8 and Y is 83; X is 8 and Y is 84; X is 8 and Y is 85; X is 8 and Y is 86; X is 8 and Y is 87; X is 8 and Y is 88; X is 8 and Y is 89; X is 8 and Y is 90; X is 8 and Y is 91; X is 8 and Y is 92; X is 8 and Y is 93; X is 8 and Y is 94; X is 8 and Y is 95; X is 8 and Y is 96; X is 8 and Y is 97; X is 8 and Y is 98; X is 8 and Y is 99; X is 8 and Y is 100; X is 8 and Y is 101; X is 8 and Y is 102; X is 8 and Y is 103; X is 8 and Y is 104; X is 8 and Y is 105; X is 8 and Y is 106; X is 8 and Y is 107; X is 8 and Y is 108; X is 8 and Y is 109; X is 8 and Y is 110; X is 8 and Y is 111; X is 8 and Y is 112; X is 8 and Y is 113; X is 8 and Y is 114; X is 8 and Y is 115; X is 8 and Y is 116; X is 8 and Y is 117; X is 8 and Y is 118; X is 8 and Y is 119; X is 8 and Y is 120; X is 8 and Y is 121; X is 8 and Y is 122; X is 8 and Y is 123; X is 8 and Y is 124; X is 8 and Y is 125; X is 8 and Y is 126; X is 8 and Y is 127; X is 8 and Y is 128; X is 8 and Y is 129; X is 8 and Y is 130; X is 8 and Y is 131; X is 8 and Y is 132; X is 8 and Y is 133; X is 8 and Y is 134; X is 8 and Y is 135; X is 8 and Y is 136; X is 8 and Y is 137; X is 8 and Y is 138; X is 8 and Y is 139; X is 8 and Y is 140; X is 8 and Y is 141; X is 8 and Y is 142; X is 8 and Y is 143; X is 8 and Y is 144; X is 8 and Y is 145; X is 8 and Y is 146; X is 8 and Y is 147; X is 8 and Y is 148; X is 8 and Y is 149; X is 8 and Y is 150; X is 8 and Y is 151; X is 8 and Y is 152; X is 8 and Y is 153; X is 8 and Y is 154; X is 8 and Y is 155; X is 8 and Y is 156; X is 8 and Y is 157; X is 8 and Y is 158; X is 8 and Y is 159; X is 8 and Y is 160; X is 8 and Y is 161; X is 8 and Y is 162; X is 8 and Y is 163; X is 8 and Y is 164; X is 8 and Y is 165; X is 8 and Y is 166; X is 8 and Y is 167; X is 8 and Y is 168; X is 8 and Y is 169; X is 8 and Y is 170; X is 8 and Y is 171; X is 8 and Y is 172; X is 8 and Y is 173; X is 8 and Y is 174; X is 8 and Y is 175; X is 8 and Y is 176; X is 8 and Y is 177; X is 8 and Y is 178; X is 8 and Y is 179; X is 8 and Y is 180; X is 8 and Y is 181; X is 8 and Y is 182; X is 8 and Y is 183; X is 8 and Y is 184; X is 8 and Y is 185; X is 8 and Y is 186; X is 9 and Y is 1; X is 9 and Y is 2; X is 9 and Y is 3; X is 9 and Y is 4; X is 9 and Y is 5; X is 9 and Y is 6; X is 9 and Y is 7; X is 9 and Y is 8; X is 9 and Y is 9; X is 9 and Y is 10; X is 9 and Y is 11; X is 9 and Y is 12; X is 9 and is 13; X is 9 and Y is 14; X is 9 and Y is 15; X is 9 and Y is 16; X is 9 and Y is 17; X is 9 and Y is 18; X is 9 and Y is 19; X is 9 and Y is 20; X is 9 and Y is 21; X is 9 and Y is 22; X is 9 and Y is 23; X is 9 and Y is 24; X is 9 and Y is 25; X is 9 and Y is 26; X is 9 and Y is 27; X is 9 and Y is 28; X is 9 and Y is 29; X is 9 and Y is 30; X is 9 and Y is 31; X is 9 and Y is 32; X is 9 and Y is 33; X is 9 and Y is 34; X is 9 and Y is 35; X is 9 and Y is 36; X is 9 and Y is 37; X is 9 and Y is 38; X is 9 and Y is 39; X is 9 and Y is 40; X is 9 and Y is 41; X is 9 and Y is 42; X is 9 and Y is 43; X is 9 and Y is 44; X is 9 and Y is 45; X is 9 and Y is 46; X is 9 and Y is 47; X is 9 and Y is 48; X is 9 and Y is 49; X is 9 and Y is 50; X is 9 and Y is 51; X is 9 and Y is 52; X is 9 and Y is 53; X is 9 and Y is 54; X is 9 and Y is 55; X is 9 and Y is 56; X is 9 and Y is 57; X is 9 and Y is 58; X is 9 and Y is 59; X is 9 and Y is 60; X is 9 and Y is 61; X is 9 and Y is 62; X is 9 and Y is 63; X is 9 and Y is 64; X is 9 and Y is 65; X is 9 and Y is 66; X is 9 and Y is 67; X is 9 and Y is 68; X is 9 and Y is 69; X is 9 and Y is 70; X is 9 and Y is 71; X is 9 and Y is 72; X is 9 and Y is 73; X is 9 and Y is 74; X is 9 and Y is 75; X is 9 and Y is 76; X is 9 and Y is 77; X is 9 and Y is 78; X is 9 and Y is 79; X is 9 and Y is 80; X is 9 and Y is 81; X is 9 and Y is 82; X is 9 and Y is 83; X is 9 and Y is 84; X is 9 and Y is 85; X is 9 and Y is 86; X is 9 and Y is 87; X is 9 and Y is 88; X is 9 and Y is 89; X is 9 and Y is 90; X is 9 and Y is 91; X is 9 and Y is 92; X is 9 and Y is 93; X is 9 and Y is 94; X is 9 and Y is 95; X is 9 and Y is 96; X is 9 and Y is 97; X is 9 and Y is 98; X is 9 and Y is 99; X is 9 and Y is 100; X is 9 and Y is 101; and X is 9 and Y is 102; X is 9 and Y is 103; X is 9 and Y is 104; X is 9 and Y is 105; X is 9 and Y is 106; X is 9 and Y is 107; X is 9 and Y is 108; X is 9 and Y is 109; X is 9 and Y is 110; X is 9 and Y is 111; X is 9 and Y is 112; X is 9 and Y is 113; X is 9 and Y is 114; X is 9 and Y is 115; X is 9 and Y is 116; X is 9 and Y is 117; X is 9 and Y is 118; X is 9 and Y is 119; X is 9 and Y is 120; X is 9 and Y is 121; X is 9 and Y is 122; X is 9 and Y is 123; X is 9 and Y is 124; X is 9 and Y is 125; X is 9 and Y is 126; X is 9 and Y is 127; X is 9 and Y is 128; X is 9 and Y is 129; X is 9 and Y is 130; X is 9 and Y is 131; X is 9 and Y is 132; X is 9 and Y is 133; X is 9 and Y is 134; X is 9 and Y is 135; X is 9 and Y is 136; X is 9 and Y is 137; X is 9 and Y is 138; X is 9 and Y is 139; X is 9 and Y is 140; X is 9 and Y is 141;

X is 9 and Y is 142; X is 9 and Y is 143; X is 9 and Y is 144; X is 9 and Y is 145; X is 9 and Y is 146; X is 9 and Y is 147; X is 9 and Y is 148; X is 9 and Y is 149; X is 9 and Y is 150; X is 9 and Y is 151; X is 9 and Y is 152; X is 9 and Y is 153; X is 9 and Y is 154; X is 9 and Y is 155; X is 9 and Y is 156; X is 9 and Y is 157; X is 9 and Y is 158; X is 9 and Y is 159; X is 9 and Y is 160; X is 9 and Y is 161; X is 9 and Y is 162; X is 9 and Y is 163; X is 9 and Y is 164; X is 9 and Y is 165; X is 9 and Y is 166; X is 9 and Y is 167; X is 9 and Y is 168; X is 9 and Y is 169; X is 9 and Y is 170; X is 9 and Y is 171; X is 9 and Y is 172; X is 9 and Y is 173; X is 9 and Y is 174; X is 9 and Y is 175; X is 9 and Y is 176; X is 9 and Y is 177; X is 9 and Y is 178; X is 9 and Y is 179; X is 9 and Y is 180; X is 9 and Y is 181; X is 9 and Y is 182; X is 9 and Y is 183; X is 9 and Y is 184; X is 9 and Y is 185; X is 9 and Y is 186; X is 10 and Y is 1; X is 10 and Y is 2; X is 10 and Y is 3; X is 10 and Y is 4; X is 10 and Y is 5; X is 10 and Y is 6; X is 10 and Y is 7; X is 10 and Y is 8; X is 10 and Y is 9; X is 10 and Y is 10; X is 10 and Y is 11; X is 10 and Y is 12; X is 10 and Y is 13; X is 10 and Y is 14; X is 10 and Y is 15; X is 10 and Y is 16; X is 10 and Y is 17; X is 10 and Y is 18; X is 10 and Y is 19; X is 10 and Y is 20; X is 10 and Y is 21; X is 10 and Y is 22; X is 10 and Y is 23; X is 10 and Y is 24; X is 10 and Y is 25; X is 10 and Y is 26; X is 10 and Y is 27; X is 10 and Y is 28; X is 10 and Y is 29; X is 10 and Y is 30; X is 10 and Y is 31; X is 10 and Y is 32; X is 10 and Y is 33; X is 10 and Y is 34; X is 10 and Y is 35; X is 10 and Y is 36; X is 10 and Y is 37; X is 10 and Y is 38; X is 10 and Y is 39; X is 10 and Y is 40; X is 10 and Y is 41; X is 10 and Y is 42; X is 10 and Y is 43; X is 10 and Y is 44; X is 10 and Y is 45; X is 10 and Y is 46; X is 10 and Y is 47; X is 10 and Y is 48; X is 10 and Y is 49; X is 10 and Y is 50; X is 10 and Y is 51; X is 10 and Y is 52; X is 10 and Y is 53; X is 10 and Y is 54; X is 10 and Y is 55; X is 10 and Y is 56; X is 10 and Y is 57; X is 10 and Y is 58; X is 10 and Y is 59; X is 10 and Y is 60; X is 10 and Y is 61; X is 10 and Y is 62; X is 10 and Y is 63; X is 10 and Y is 64; X is 10 and Y is 65; X is 10 and Y is 66; X is 10 and Y is 67; X is 10 and Y is 68; X is 10 and Y is 69; X is 10 and Y is 70; X is 10 and Y is 71; X is 10 and Y is 72; X is 10 and Y is 73; X is 10 and Y is 74; X is 10 and Y is 75; X is 10 and Y is 76; X is 10 and Y is 77; X is 10 and Y is 78; X is 10 and Y is 79; X is 10 and Y is 80; X is 10 and Y is 81; X is 10 and Y is 82; X is 10 and Y is 83; X is 10 and Y is 84; X is 10 and Y is 85; X is 10 and Y is 86; X is 10 and Y is 87; X is 10 and Y is 88; X is 10 and Y is 89; X is 10 and Y is 90; X is 10 and Y is 91; X is 10 and Y is 92; X is 10 and Y is 93; X is 10 and Y is 94; X is 10 and Y is 95; X is 10 and Y is 96; X is 10 and Y is 97; X is 10 and Y is 98; X is 10 and Y is 99; X is 10 and Y is 100; X is 10 and Y is 101; X is 10 and Y is 102; X is 10 and Y is 103; X is 10 and Y is 104; X is 10 and Y is 105; X is 10 and Y is 106; X is 10 and Y is 107; X is 10 and Y is 108; X is 10 and Y is 109; X is 10 and Y is 110; X is 10 and Y is 111; X is 10 and Y is 112; X is 10 and Y is 113; X is 10 and Y is 114; X is 10 and Y is 115; X is 10 and Y is 116; X is 10 and Y is 117; X is 10 and Y is 118; X is 10 and Y is 119; X is 10 and Y is 120; X is 10 and Y is 121; X is 10 and Y is 122; X is 10 and Y is 123; X is 10 and Y is 124; X is 10 and Y is 125; X is 10 and Y is 126; X is 10 and Y is 127; X is 10 and Y is 128; X is 10 and Y is 129; X is 10 and Y is 130; X is 10 and Y is 131; X is 10 and Y is 132; X is 10 and Y is 133; X is 10 and Y is 134; X is 10 and Y is 135; X is 10 and Y is 136; X is 10 and Y is 137; X is 10 and Y is 138; X is 10 and Y is 139; X is 10 and Y is 140; X is 10 and Y is 141; X is 10 and Y is 142; X is 10 and Y is 143; X is 10 and Y is 144; X is 10 and Y is 145; X is 10 and Y is 146; X is 10 and Y is 147; X is 10 and Y is 148; X is 10 and Y is 149; X is 10 and Y is 150; X is 10 and Y is 151; X is 10 and Y is 152; X is 10 and Y is 153; X is 10 and Y is 154; X is 10 and Y is 155; X is 10 and Y is 156; X is 10 and Y is 157; X is 10 and Y is 158; X is 10 and Y is 159; X is 10 and Y is 160; X is 10 and Y is 161; X is 10 and Y is 162; X is 10 and Y is 163; X is 10 and Y is 164; X is 10 and Y is 165; X is 10 and Y is 166; X is 10 and Y is 167; X is 10 and Y is 168; X is 10 and Y is 169; X is 10 and Y is 170; X is 10 and Y is 171; X is 10 and Y is 172; X is 10 and Y is 173; X is 10 and Y is 174; X is 10 and Y is 175; X is 10 and Y is 176; X is 10 and Y is 177; X is 10 and Y is 178; X is 10 and Y is 179; X is 10 and Y is 180; X is 10 and Y is 181; X is 10 and Y is 182; X is 10 and Y is 183; X is 10 and Y is 184; X is 10 and Y is 185; X is 10 and Y is 186; X is 11 and Y is 1; X is 11 and Y is 2; X is 11 and Y is 3; X is 11 and Y is 4; X is 11 and Y is 5; X is 11 and Y is 6; X is 11 and Y is 7; X is 11 and Y is 8; X is 11 and Y is 9; X is 11 and Y is 10; X is 11 and Y is 11; X is 11 and Y is 12; X is 11 and Y is 13; X is 11 and Y is 14; X is 11 and Y is 15; X is 11 and Y is 16; X is 11 and Y is 17; X is 11 and Y is 18; X is 11 and Y is 19; X is 11 and Y is 20; X is 11 and Y is 21; X is 11 and Y is 22; X is 11 and Y is 23; X is 11 and Y is 24; X is 11 and Y is 25; X is 11 and Y is 26; X is 11 and Y is 27; X is 11 and Y is 28; X is 11 and Y is 29; X is 11 and Y is 30; X is 11 and Y is 31; X is 11 and Y is 32; X is 11 and Y is 33; X is 11 and Y is 34; X is 11 and Y is 35; X is 11 and Y is 36; X is 11 and Y is 37; X is 11 and Y is 38; X is 11 and Y is 39; X is 11 and Y is 40; X is 11 and Y is 41; X is 11 and Y is 42; X is 11 and Y is 43; X is 11 and Y is 44; X is 11 and Y is 45; X is 11 and 46; X is 11 and 47; X is 11 and Y is 48; X is 11 and Y is 49; X is 11 and Y is 50; X is 11 and Y is 51; X is 11 and Y is 52; X is 11 and Y is 53; X is 11 and Y is 54; X is 11 and Y is 55; X is 11 and Y is 56; X is 11 and Y is 57; X is 11 and Y is 58; X is 11 and Y is 59; X is 11 and Y is 60; X is 11 and Y is 61; X is 11 and Y is 62; X is 11 and Y is 63; X is 11 and Y is 64; X is 11 and Y is 65; X is 11 and Y is 66; X is 11 and Y is 67; X is 11 and Y is 68; X is 11 and Y is 69; X is 11 and Y is 70; X is 11 and Y is 71; X is 11 and Y is 72; X is 11 and Y is 73; X is 11 and Y is 74; X is 11 and Y is 75; X is 11 and Y is 76; X is 11 and Y is 77; X is 11 and Y is 78; X is 11 and Y is 79; X is 11 and Y is 80; X is 11 and Y is 81; X is 11 and Y is 82; X is 11 and Y is 83; X is 11 and Y is 84; X is 11 and Y is 85; X is 11 and Y is 86; X is 11 and Y is 87; X is 11 and Y is 88; X is 11 and Y is 89; X is 11 and Y is 90; X is 11 and Y is 91; X is 11 and Y is 92; X is 11 and Y is 93; X is 11 and Y is 94; X is 11 and Y is 95; X is 11 and Y is 96; X is 11 and Y is 97; X is 11 and Y is 98; X is 11 and Y is 99; X is 11 and Y is 100; X is 11 and Y is 101; X is 11 and Y is 102; X is 11 and Y is 103; X is 11 and Y is 104; X is 11 and Y is 105; X is 11 and Y is 106; X is 11 and Y is 107; X is 11 and Y is 108; X is 11 and Y is 109; X is 11 and Y is 110; X is 11 and Y is 111; X is 11 and Y is 112; X is 11 and Y is 113; X is 11 and Y is 114; X is 11 and Y is 115; X is 11 and Y is 116; X is 11 and Y is 117; X is 11 and Y is 118; X is 11 and Y is 119; X is 11 and Y is 120; X is 11 and Y is 121; X is 11 and Y is 122; X is 11 and Y is 123; X is 11 and Y is 124; X is 11 and Y is 125; X is 11 and Y is 126; X is 11 and Y is 127; X is 11 and Y is 128; X is 11 and Y is 129; X is 11 and Y is 130; X is 11 and Y is 131; X is 11 and Y is 132; X is 11 and Y is 133; X is 11 and Y is 134; X is 11 and Y is 135; X is 11 and Y is 136; X is 11 and Y is 137; X is 11 and Y is 138; X is 11 and Y is 139; X is 11 and Y is 140; X is 11 and Y is 141; X is 11 and Y is 142; X is 11 and Y is 143; X is 11 and Y is 144; X is 11 and Y is 145; X is 11 and Y is 146; X is 11 and Y is 147; X is 11 and Y is 148; X is 11 and Y is 149; X is 11 and Y is 150; X is 11 and Y is 151; X is 11 and Y is 152; X is 11 and Y is 153; X is 11 and Y is 154; X is 11 and Y is 155; X is 11 and Y is 156; X is 11 and Y is 157; X is 11 and Y is 158; X is 11 and Y is 159; X is 11 and Y is 160; X is 11 and Y is 161; X is 11 and Y is 162; X is 11 and Y is 163; X is 11 and Y is 164; X is 11 and Y is 165; X is 11 and Y is 166; X is 11 and Y is 167; X is 11 and Y is 168; X is 11 and Y is 169; X is 11 and Y is 170; X is 11 and Y is 171; X is 11 and Y is 172; X is 11 and Y is 173; X is 11 and Y is 174; X is 11 and Y is 175; X is 11 and Y is 176; X is 11 and Y is 177; X is 11 and Y is 178; X is 11 and Y is 179; X is 11 and Y is 180; X is 11 and Y is 181; X is 11 and Y is 182; X is 11 and Y is 183; X is 11 and Y is 184; X is 11 and Y is 185; X is 11 and Y is 186;

X is 12 and Y is 1; X is 12 and Y is 2; X is 12 and Y is 3; X is 12 and Y is 4; X is 12 and Y is 5; X is 12 and Y is 6; X is 12 and Y is 7; X is 12 and Y is 8; X is 12 and Y is 9; X is 12 and Y is 10; X is 12 and Y is 11; X is 12 and Y is 12; X is 12 and Y is 13; X is 12 and Y is 14; X is 12 and Y is 15; X is 12 and Y is 16; X is 12 and Y is 17; X is 12 and Y is 18; X is 12 and Y is 19; X is 12 and Y is 20; X is 12 and Y is 21; X is 12 and Y is 22; X is 12 and Y is 23; X is 12 and Y is 24; X is 12 and Y is 25; X is 12 and Y is 26; X is 12 and Y is 27; X is 12 and Y is 28; X is 12 and Y is 29; X is 12 and Y is 30; X is 12 and Y is 31; X is 12 and Y is 32; X is 12 and Y is 33; X is 12 and Y is 34; X is 12 and Y is 35; X is 12 and Y is 36; X is 12 and Y is 37; X is 12 and Y is 38; X is 12 and Y is 39; X is 12 and Y is 40; X is 12 and Y is 41; X is 12 and Y is 42; X is 12 and Y is 43; X is 12 and Y is 44; X is 12 and Y is 45; X is 12 and Y is 46; X is 12 and Y is 47; X is 12 and Y is 48; X is 12 and Y is 49; X is 12 and Y is 50; X is 12 and Y is 51; X is 12 and Y is 52; X is 12 and Y is 53; X is 12 and Y is 54; X is 12 and Y is 55; X is 12 and Y is 56; X is 12 and Y is 57; X is 12 and Y is 58; X is 12 and Y is 59; X is 12 and Y is 60; X is 12 and Y is 61; X is 12 and Y is 62; X is 12 and Y is 63; X is 12 and Y is 64; X is 12 and Y is 65; X is 12 and Y is 66; X is 12 and Y is 67; X is 12 and Y is 68; X is 12 and Y is 69; X is 12 and Y is 70; X is 12 and Y is 71; X is 12 and Y is 72; X is 12 and Y is 73; X is 12 and Y is 74; X is 12 and Y is 75; X is 12 and Y is 76; X is 12 and Y is 77; X is 12 and Y is 78; X is 12 and Y is 79; X is 12 and Y is 80; X is 12 and Y is 81; X is 12 and Y is 82; X is 12 and Y is 83; X is 12 and Y is 84; X is 12 and Y is 85; X is 12 and Y is 86; X is 12 and Y is 87; X is 12 and Y is 88; X is 12 and Y is 89; X is 12 and Y is 90; X is 12 and Y is 91; X is 12 and Y is 92; X is 12 and Y is 93; X is 12 and Y is 94; X is 12 and Y is 95; X is 12 and Y is 96; X is 12 and Y is 97; X is 12 and Y is 98; X is 12 and Y is 99; X is 12 and Y is 100; X is 12 and Y is 101; X is 12 Y is 102; X is 12 and Y is 103; X is 12 and Y is 104; X is 12 and Y is 105; X is 12 and Y is 106; X is 12 and Y is 107; X is 12 and Y is 108; X is 12 and Y is 109; X is 12 and Y is 110; X is 12 and Y is 111; X is 12 and Y is 112; X is 12 and Y is 113; X is 12 and Y is 114; X is 12 and Y is 115; X is 12 and Y is 116; X is 12 and Y is 117; X is 12 and Y is 118; X is 12 and Y is 119; X is 12 and Y is 120; X is 12 and Y is 121; X is 12 and Y is 122; X is 12 and Y is 123; X is 12 and Y is 124; X is 12 and Y is 125; X is 12 and Y is 126; X is 12 and Y is 127; X is 12 and Y is 128; X is 12 and Y is 129; X is 12 and Y is 130; X is 12 and Y is 131; X is 12 and Y is 132; X is 12 and Y is 133; X is 12 and Y is 134; X is 12 and Y is 135; X is 12 and Y is 136; X is 12 and Y is 137; X is 12 and Y is 138; X is 12 and Y is 139; X is 12 and Y is 140; X is 12 and Y is 141; X is 12 and Y is 142; X is 12 and Y is 143; X is 12 and Y is 144; X is 12 and Y is 145; X is 12 and Y is 146; X is 12 and Y is 147; X is 12 and Y is 148; X is 12 and Y is 149; X is 12 and Y is 150; X is 12 and Y is 151; X is 12 and Y is 152; X is 12 and Y is 153; X is 12 and Y is 154; X is 12 and Y is 155; X is 12 and Y is 156; X is 12 and Y is 157; X is 12 and Y is 158; X is 12 and Y is 159; X is 12 and Y is 160; X is 12 and Y is 161; X is 12 and Y is 162; X is 12 and Y is 163; X is 12 and Y is 164; X is 12 and Y is 165; X is 12 and Y is 166; X is 12 and Y is 167; X is 12 and Y is 168; X is 12 and Y is 169; X is 12 and Y is 170; X is 12 and Y is 171; X is 12 and Y is 172; X is 12 and Y is 173; X is 12 and Y is 174; X is 12 and Y is 175; X is 12 and Y is 176; X is 12 and Y is 177; X is 12 and Y is 178; X is 12 and Y is 179; X is 12 and Y is 180; X is 12 and Y is 181; X is 12 and Y is 182; X is 12 and Y is 183; X is 12 and Y is 184; X is 12 and Y is 185; X is 12 and Y is 186;

X is 13 and Y is 1; X is 13 and Y is 2; X is 13 and Y is 3; X is 13 and Y is 4; X is 13 and Y is 5; X is 13 and Y is 6; X is 13 and Y is 7; X is 13 and Y is 8; X is 13 and Y is 9; X is 13 and Y is 10; X is 13 and Y is 11; X is 13 and Y is 12; X is 13 and Y is 13; X is 13 and Y is 14; X is 13 and Y is 15; X is 13 and Y is 16; X is 13 and Y is 17; X is 13 and Y is 18; X is 13 and Y is 19; X is 13 and Y is 20; X is 13 and Y is 21; X is 13 and Y is 22; X is 13 and Y is 23; X is 13 and Y is 24; X is 13 and Y is 25; X is 13 and Y is 26; X is 13 and Y is 27; X is 13 and Y is 28; X is 13 and Y is 29; X is 13 and Y is 30; X is 13 and Y is 31; X is 13 and Y is 32; X is 13 and Y is 33; X is 13 and Y is 34; X is 13 and Y is 35; X is 13 and Y is 36; X is 13 and Y is 37; X is 13 and Y is 38; X is 13 and Y is 39; X is 13 and Y is 40; X is 13 and Y is 41; X is 13 and Y is 42; X is 13 and Y is 43; X is 13 and Y is 44; X is 13 and Y is 45; X is 13 and Y is 46; X is 13 and Y is 47; X is 13 and Y is 48; X is 13 and Y is 49; X is 13 and Y is 50; X is 13 and Y is 51; X is 13 and Y is 52; X is 13 and Y is 53; X is 13 and Y is 54; X is 13 and Y is 55; X is 13 and Y is 56; X is 13 and Y is 57; X is 13 and Y is 58; X is 13 and Y is 59; X is 13 and Y is 60; X is 13 and Y is 61; X is 13 and Y is 62; X is 13 and Y is 63; X is 13 and Y is 64; X is 13 and Y is 65; X is 13 and Y is 66; X is 13 and Y is 67; X is 13 and Y is 68; X is 13 and Y is 69; X is 13 and Y is 70; X is 13 and Y is 71; X is 13 and Y is 72; X is 13 and Y is 73; X is 13 and Y is 74; X is 13 and Y is 75; X is 13 and Y is 76; X is 13 and Y is 77; X is 13 and Y is 78; X is 13 and Y is 79; X is 13 and Y is 80; X is 13 and Y is 81; X is 13 and Y is 82; X is 13 and Y is 83; X is 13 and Y is 84; X is 13 and Y is 85; X is 13 and Y is 86; X is 13 and Y is 87; X is 13 and Y is 88; X is 13 and Y is 89; X is 13 and Y is 90; X is 13 and Y is 91; X is 13 and Y is 92; X is 13 and Y is 93; X is 13 and Y is 94; X is 13 and Y is 95; X is 13 and Y is 96; X is 13 and Y is 97; X is 13 and Y is 98; X is 13 and Y is 99; X is 13 and Y is 100; X is 13 and Y is 101; X is 13 and Y is 102; X is 13 and Y is 103; X is 13 and Y is 104; X is 13 and Y is 105; X is 13 and Y is 106; X is 13 and Y is 107; X is 13 and Y is 108; X is 13 and Y is 109; X is 13 and Y is 110;

X is 13 and Y is 111; X is 13 and Y is 112; X is 13 and Y is 113; X is 13 and Y is 114; X is 13 and Y is 115; X is 13 and Y is 116; X is 13 and Y is 117; X is 13 and is 118; X is 13 and Y is 119; X is 13 and Y is 120; X is 13 and Y is 121; X is 13 and Y is 122; X is 13 and Y is 123; X is 13 and Y is 124; X is 13 and Y is 125; X is 13 and Y is 126; X is 13 and Y is 127; X is 13 and Y is 128; X is 13 and Y is 129; X is 13 and Y is 130; X is 13 and Y is 131; X is 13 and Y is 132; X is 13 and Y is 133; X is 13 and Y is 134; X is 13 and Y is 135; X is 13 and Y is 136; X is 13 and Y is 137; X is 13 and Y is 138; X is 13 and Y is 139; X is 13 and Y is 140; X is 13 and Y is 141; X is 13 and Y is 142; X is 13 and Y is 143; X is 13 and Y is 144; X is 13 and Y is 145;

X is 13 and Y is 146; X is 13 and Y is 147; X is 13 and Y is 148; X is 13 and Y is 149; X is 13 and Y is 150; X is 13 and Y is 151; X is 13 and Y is 152; X is 13 and Y is 153; X is 13 and Y is 154; X is 13 and Y is 155; X is 13 and Y is 156; X is 13 and Y is 157; X is 13 and Y is 158; X is 13 and Y is 159; X is 13 and Y is 160; X is 13 and Y is 161; X is 13 and Y is 162; X is 13 and Y is 163; X is 13 and Y is 164; X is 13 and Y is 165; X is 13 and Y is 166; X is 13 and Y is 167; X is 13 and Y is 168; X is 13 and Y is 169; X is 13 and Y is 170; X is 13 and Y is 171; X is 13 and Y is 172; X is 13 and Y is 173; X is 13 and Y is 174; X is 13 and Y is 175; X is 13 and Y is 176; X is 13 and Y is 177; X is 13 and Y is 178; X is 13 and Y is 179; X is 13 and Y is 180; X is 13 and Y is 181; X is 13 and Y is 182; X is 13 and Y is 183; X is 13 and Y is 184; X is 13 and Y is 185; X is 13 and Y is 186;

X is 14 and Y is 1; X is 14 and Y is 2; X is 14 and Y is 3; X is 14 and Y is 4; X is 14 and Y is 5; X is 14 and Y is 6; X is 14 and Y is 7; X is 14 and Y is 8; X is 14 and Y is 9; X is 14 and Y is 10; X is 14 and Y is 11; X is 14 and Y is 12; X is 14 and Y is 13; X is 14 and Y is 14; X is 14 and Y is 15; X is 14 and Y is 16; X is 14 and Y is 17; X is 14 and Y is 18; X is 14 and Y is 19; X is 14 and Y is 20; X is 14 and Y is 21; X is 14 and Y is 22; X is 14 and Y is 23; X is 14 and Y is 24; X is 14 and Y is 25; X is 14 and Y is 26; X is 14 and Y is 27; X is 14 and Y is 28; X is 14 and Y is 29; X is 14 and Y is 30; X is 14 and Y is 31; X is 14 and Y is 32; X is 14 and Y is 33; X is 14 and Y is 34; X is 14 and Y is 35; X is 14 and Y is 36; X is 14 and Y is 37; X is 14 and Y is 38; X is 14 and Y is 39; X is 14 and Y is 40; X is 14 and Y is 41; X is 14 and Y is 42; X is 14 and Y is 43; X is 14 and Y is 44; X is 14 and Y is 45; X is 14 and Y is 46; X is 14 and Y is 47; X is 14 and Y is 48; X is 14 and Y is 49; X is 14 and Y is 50; X is 14 and Y is 51; X is 14 and Y is 52; X is 14 and Y is 53; X is 14 and Y is 54; X is 14 and Y is 55; X is 14 and Y is 56; X is 14 and Y is 57; X is 14 and Y is 58; X is 14 and Y is 59; X is 14 and Y is 60; X is 14 and Y is 61; X is 14 and Y is 62; X is 14 and Y is 63; X is 14 and is 64; X is 14 and Y is 65; X is 14 and Y is 66; X is 14 and Y is 67; X is 14 and Y is 68; X is 14 and Y is 69; X is 14 and Y is 70; X is 14 and Y is 71; X is 14 and Y is 72; X is 14 and Y is 73; X is 14 and Y is 74; X is 14 and Y is 75; X is 14 and Y is 76; X is 14 and Y is 77; X is 14 and Y is 78; X is 14 and Y is 79; X is 14 and Y is 80; X is 14 and Y is 81; X is 14 and Y is 82; X is 14 and Y is 83; X is 14 and Y is 84; X is 14 and Y is 85; X is 14 and Y is 86; X is 14 and Y is 87; X is 14 and Y is 88; X is 14 and Y is 89; X is 14 and Y is 90; X is 14 and Y is 91; X is 14 and Y is 92; X is 14 and Y is 93; X is 14 and Y is 94; X is 14 and Y is 95; X is 14 and Y is 96; X is 14 and Y is 97; X is 14 and Y is 98; X is 14 and Y is 99; X is 14 and Y is 100; X is 14 and Y is 101; X is 14 and Y is 102; X is 14 and Y is 103; X is 14 and Y is 104; X is 14 and Y is 105; X is 14 and Y is 106; X is 14 and Y is 107; X is 14 and Y is 108; X is 14 and Y is 109; X is 14 and Y is 110; X is 14 and Y is 111; X is 14 and Y is 112; X is 14 and Y is 113; X is 14 and Y is 114; X is 14 and Y is 115; X is 14 and Y is 116; X is 14 and Y is 117; X is 14 and Y is 118; X is 14 and Y is 119; X is 14 and Y is 120; X is 14 and Y is 121; X is 14 and Y is 122; X is 14 and Y is 123; X is 14 and Y is 124; X is 14 and Y is 125; X is 14 and Y is 126; X is 14 and Y is 127; X is 14 and Y is 128; X is 14 and Y is 129; X is 14 and Y is 130; X is 14 and Y is 131; X is 14 and Y is 132; X is 14 and Y is 133; X is 14 and Y is 134; X is 14 and Y is 135; X is 14 and Y is 136; X is 14 and Y is 137; X is 14 and Y is 138; X is 14 and Y is 139; X is 14 and Y is 140; X is 14 and Y is 141; X is 14 and Y is 142; X is 14 and Y is 143; X is 14 and Y is 144; X is 14 and Y is 145; X is 14 and Y is 146; X is 14 and Y is 147; X is 14 and Y is 148; X is 14 and Y is 149; X is 14 and Y is 150; X is 14 and Y is 151; X is 14 and Y is 152; X is 14 and Y is 153; X is 14 and Y is 154; X is 14 and Y is 155; X is 14 and Y is 156; X is 14 and Y is 157; X is 14 and Y is 158; X is 14 and Y is 159; X is 14 and Y is 160; X is 14 and Y is 161; X is 14 and Y is 162; X is 14 and Y is 163; X is 14 and Y is 164; X is 14 and Y is 165; X is 14 and Y is 166; X is 14 and Y is 167; X is 14 and Y is 168; X is 14 and Y is 169; X is 14 and Y is 170; X is 14 and Y is 171; X is 14 and Y is 172; X is 14 and Y is 173; X is 14 and Y is 174; X is 14 and Y is 175; X is 14 and Y is 176; X is 14 and Y is 177; X is 14 and Y is 178; X is 14 and Y is 179; X is 14 and Y is 180; X is 14 and Y is 181; X is 14 and Y is 182; X is 14 and Y is 183; X is 14 and Y is 184; X is 14 and Y is 185; X is 14 and Y is 186;

X is 15 and Y is 1; X is 15 and Y is 2; X is 15 and Y is 3; X is 15 and Y is 4; X is 15 and Y is 5; X is 15 and Y is 6; X is 15 and Y is 7; X is 15 and Y is 8; X is 15 and Y is 9; X is 15 and Y is 10; X is 15 and Y is 11; X is 15 and Y is 12; X is 15 and Y is 13; X is 15 and is 14; X is 15 and Y is 15; X is 15 and Y is 16; X is 15 and Y is 17; X is 15 and Y is 18; X is 15 and Y is 19; X is 15 and Y is 20; X is 15 and Y is 21; X is 15 and Y is 22; X is 15 and Y is 23; X is 15 and Y is 24; X is 15 and Y is 25; X is 15 and Y is 26; X is 15 and Y is 27; X is 15 and Y is 28; X is 15 and Y is 29; X is 15 and Y is 30; X is 15 and Y is 31; X is 15 and Y is 32; X is 15 and Y is 33; X is 15 and Y is 34; X is 15 and Y is 35; X is 15 and Y is 36; X is 15 and Y is 37; X is 15 and Y is 38; X is 15 and Y is 39; X is 15 and Y is 40; X is 15 and Y is 41; X is 15 and Y is 42; X is 15 and Y is 43; X is 15 and Y is 44; X is 15 and Y is 45; X is 15 and Y is 46; X is 15 and Y is 47; X is 15 and Y is 48; X is 15 and Y is 49; X is 15 and Y is 50; X is 15 and Y is 51; X is 15 and Y is 52; X is 15 and Y is 53; X is 15 and Y is 54; X is 15 and Y is 55; X is 15 and Y is 56; X is 15 and Y is 57; X is 15 and Y is 58; X is 15 and Y is 59; X is 15 and Y is 60; X is 15 and Y is 61; X is 15 and Y is 62; X is 15 and Y is 63; X is 15 and Y is 64; X is 15 and Y is 65; X is 15 and Y is 66; X is 15 and Y is 67; X is 15 and Y is 68; X is 15 and Y is 69; X is 15 and Y is 70; X is 15 and Y is 71; X is 15 and Y is 72; X is 15 and Y is 73; X is 15 and Y is 74; X is 15 and Y is 75; X is 15 and Y is 76; X is 15 and Y is 77; X is 15 and Y is 78; X is 15 and Y is 79; X is 15 and Y is 80; X is 15 and Y is 81; X is 15 and Y is 82; X is 15 and Y is 83; X is 15 and Y is 84; X is 15 and Y is 85; X is 15 and Y is 86; X is 15 and Y is 87; X is 15 and Y is 88; X is 15 and Y is 89; X is 15 and Y is 90; X is 15 and Y is 91; X is 15 and Y is 92; X is 15 and Y is 93; X is 15 and Y is 94; X is 15 and Y is 95; X is 15 and Y is 96; X is 15 and Y is 97; X is 15 and Y is 98; X is 15 and Y is 99; X is 15 and Y is 100; X is 15 and Y is 101; X is 15 and Y is 102; X is 15 and Y is 103; X is 15 and Y is 104; X is 15 and Y is 105; X is 15 and Y is 106; X is 15 and Y is 107; X is 15 and Y is 108; X is 15 and Y is 109; X is 15 and Y is 110; X is 15 and Y is 111; X is 15 and Y is 112; X is 15 and Y is 113; X is 15 and Y is 114; X is 15 and Y is 115; X is 15 and Y is 116; X is 15 and Y is 117; X is 15 and Y is 118; X is 15 and Y is 119; X is 15 and Y is 120; X is 15 and Y is 121; X is 15 and Y is 122; X is 15 and Y is 123; X is 15 and Y is 124; X is 15 and Y is 125; X is 15 and Y is 126; X is 15 and Y is 127; X is 15 and Y is 128; X is 15 and Y is 129; X is 15 and Y is 130; X is 15 and Y is 131; X is 15 and Y is 132; X is 15 and Y is 133; X is 15 and Y is 134; X is 15 and Y is 135; X is 15 and Y is 136; X is 15 and Y is 137; X is 15 and Y is 138; X is 15 and Y is 139; X is 15 and Y is 140; X is 15 and Y is 141; X is 15 and Y is 142; X is 15 and Y is 143; X is 15 and Y is 144; X is 15 and Y is 145; X is 15 and Y is 146; X is 15 and Y is 147; X is 15 and Y is 148; X is 15 and Y is 149; X is 15 and Y is 150; X is 15 and Y is 151; X is 15 and Y is 152; X is 15 and Y is 153; X is 15 and Y is 154; X is 15 and Y is 155; X is 15 and Y is 156; X is 15 and Y is 157; X is 15 and Y is 158; X is 15 and Y is 159; X is 15 and Y is 160; X is 15 and Y is 161; X is 15 and Y is 162; X is 15 and Y is 163; X is 15 and Y is 164; X is 15 and Y is 165; X is 15 and Y is 166; X is 15 and Y is 167; X is 15 and Y is 158; X is 15 and Y is 169; X is 15 and Y is 170; X is 15 and Y is 171; X is 15 and Y is 172; X is 15 and Y is 173; X is 15 and Y is 174; X is 15 and Y is 175; X is 15 and Y is 176; X is 15 and Y is 177; X is 15 and Y is 178; X is 15 and Y is 179; X is 15 and Y is 180; X is 15 and Y is 181; X is 15 and Y is 182; X is 15 and Y is 183; X is 15 and Y is 184; X is 15 and Y is 185; X is 15 and Y is 186;

X is 16 and Y is 1; X is 16 and Y is 2; X is 16 and Y is 3; X is 16 and Y is 4; X is 16 and Y is 5; X is 16 and Y is 6; X is 16 and Y is 7; X is 16 and Y is 8; X is 16 and Y is 9; X is 16 and Y is 10; X is 16 and Y is 11; X is 16 and Y is 12; X is 16 and Y is 13; X is 16 and Y is 14; X is 16 and Y is 15; X is 16 and Y is 16; X is 16 and Y is 17; X is 16 and Y is 18; X is 16 and Y is 19; X is 16 and Y is 20; X is 16 and Y is 21; X is 16 and Y is 22; X is 16 and Y is 23; X is 16 and Y is 24; X is 16 and Y is 25; X is 16 and Y is 26; X is 16 and Y is 27; X is 16 and Y is 28; X is 16 and Y is 29; X is 16 and Y is 30; X is 16 and Y is 31; X is 16 and Y is 32; X is 16 and Y is 33; X is 16 and Y is 34; X is 16 and Y is 35; X is 16 and Y is 36; X is 16 and Y is 37; X is 16 and Y is 38; X is 16 and Y is 39; X is 16 and Y is 40; X is 16 and Y is 41; X is 16 and Y is 42; X is 16 and Y is 43; X is 16 and Y is 44; X is 16 and Y is 45; X is 16 and Y is 46; X is 16 and Y is 47; X is 16 and Y is 48; X is 16 and Y is 49; X is 16 and Y is 50; X is 16 and Y is 51; X is 16 and Y is 52; X is 16 and Y is 53; X is 16 and Y is 54; X is 16 and Y is 55; X is 16 and Y is 56; X is 16 and Y is 57; X is 16 and Y is 58; X is 16 and Y is 59; X is 16 and Y is 60; X is 16 and Y is 61; X is 16 and Y is 62; X is 16 and Y is 63; X is 16 and Y is 64; X is 16 and Y is 65; X is 16 and Y is 66; X is 16 and Y is 67; X is 16 and Y is 68; X is 16 and Y is 69; X is 16 and Y is 70; X is 16 and Y is 71; X is 16 and Y is 72; X is 16 and Y is 73; X is 16 and Y is 74; X is 16 and Y is 75; X is 16 and Y is 76; X is 16 and Y is 77; X is 16 and Y is 78; X is 16 and Y is 79; X is 16 and Y is 80; X is 16 and Y is 81; X is 16 and Y is 82; X is 16 and Y is 83; X is 16 and Y is 84; X is 16 and Y is 85; X is 16 and Y is 86; X is 16 and Y is 87; X is 16 and Y is 88; X is 16 and Y is 89; X is 16 and Y is 90; X is 16 and Y is 91; X is 16 and Y is 92; X is 16 and Y is 93; X is 16 and Y is 94; X is 16 and Y is 95; X is 16 and Y is 96; X is 16 and Y is 97; X is 16 and Y is 98; X is 16 and Y is 99; X is 16 and Y is 100; X is 16 and Y is 101; X is 16 and Y is 102; X is 16 and Y is 103; X is 16 and Y is 104; X is 16 and Y is 105; X is 16 and Y is 106; X is 16 and Y is 107; X is 16 and Y is 108; X is 16 and Y is 109; X is 16 and Y is 110; X is 16 and Y is 111; X is 16 and Y is 112; X is 16 and Y is 113; X is 16 and Y is 114; X is 16 and Y is 115; X is 16 and Y is 116; X is 16 and Y is 117; X is 16 and Y is 118; X is 16 and Y is 119; X is 16 and Y is 120; X is 16 and Y is 121; X is 16 and Y is 122; X is 16 and Y is 123; X is 16 and Y is 124; X is 16 and Y is 125; X is 16 and Y is 126; X is 16 and Y is 127; X is 16 and Y is 128; X is 16 and Y is 129; X is 16 and Y is 130; X is 16 and Y is 131; X is 16 and Y is 132; X is 16 and Y is 133; X is 16 and Y is 134; X is 16 and Y is 135; X is 16 and Y is 136; X is 16 and Y is 137; X is 16 and Y is 138; X is 16 and Y is 139; X is 16 and Y is 140; X is 16 and Y is 141; X is 16 and Y is 142; X is 16 and Y is 143; X is 16 and Y is 144; X is 16 and Y is 145; X is 16 and Y is 146; X is 16 and Y is 147; X is 16 and Y is 148; X is 16 and Y is 149; X is 16 and Y is 150; X is 16 and Y is 151; X is 16 and Y is 152; X is 16 and Y is 153; X is 16 and Y is 154; X is 16 and Y is 155; X is 16 and Y is 156; X is 16 and Y is 157; X is 16 and Y is 158; X is 16 and Y is 159; X is 16 and Y is 160; X is 16 and Y is 161; X is 16 and Y is 162; X is 16 and Y is 163; X is 16 and Y is 164; X is 16 and Y is 165; X is 16 and Y is 166; X is 16 and Y is 167; X is 16 and Y is 168; X is 16 and Y is 169; X is 16 and Y is 170; X is 16 and Y is 171; X is 16 and Y is 172; X is 16 and Y is 173; X is 16 and Y is 174; X is 16 and Y is 175; X is 16 and Y is 176; X is 16 and Y is 177; X is 16 and Y is 178; X is 16 and Y is 179; X is 16 and Y is 180; X is 16 and Y is 181; X is 16 and Y is 182; X is 16 and Y is 183; X is 16 and Y is 184; X is 16 and Y is 185; X is 16 and Y is 186;

X is 17 and Y is 1; X is 17 and Y is 2; X is 17 and Y is 3; X is 17 and Y is 4; X is 17 and Y is 5; X is 17 and Y is 6; X is 17 and Y is 7; X is 17 and Y is 8; X is 17 and Y is 9; X is 17 and Y is 10; X is 17 and Y is 11; X is 17 and Y is 12; X is 17 and Y is 13; X is 17 and Y is 14; X is 17 and Y is 15; X is 17 and Y is 16; X is 17 and Y is 17; X is 17 and Y is 18; X is 17 and Y is 19; X is 17 and Y is 20; X is 17 and Y is 21; X is 17 and Y is 22; X is 17 and Y is 23; X is 17 and Y is 24; X is 17 and Y is 25; X is 17 and Y is 26; X is 17 and Y is 27; X is 17 and Y is 28; X is 17 and Y is 29; X is 17 and Y is 30; X is 17 and Y is 31; X is 17 and Y is 32; X is 17 and Y is 33; X is 17 and Y is 34; X is 17 and Y is 35; X is 17 and Y is 36; X is 17 and Y is 37; X is 17 and Y is 38; X is 17 and Y is 39; X is 17 and Y is 40; is 17 and Y is 41; X is 17 and Y is 42; X is 17 and Y is 43; X is 17 and Y is 44; X is 17 and Y is 45; X is 17 and Y is 46; X is 17 and Y is 47; X is 17 and Y is 48; X is 17 and Y is 49; X is 17 and Y is 50; X is 17 and Y is 51; X is 17 and Y is 52; X is 17 and Y is 53; X is 17 and Y is 54; X is 17 and Y is 55; X is 17 and Y is 56; X is 17 and Y is 57; X is 17 and Y is 58; X is 17 and Y is 59; X is 17 and Y is 60; X is 17 and Y is 61; X is 17 and Y is 62; X is 17 and Y is 63; X is 17 and Y is 64; X is 17 and Y is 65; X is 17 and Y is 66; X is 17 and Y is 67; X is 17 and Y is 68; X is 17 and Y is 69; X is 17 and Y is 70; X is 17 and Y is 71; X is 17 and Y is 72; X is 17 and Y is 73; X is 17 and Y is 74; X is 17 and Y is 75; X is 17 and Y is 76; X is 17 and Y is 77; X is 17 and Y is 78; X is 17 and Y is 79; X is 17 and Y is 80; X is 17 and Y is 81; X is 17 and Y is 82; X is 17 and Y is 83; X is 17 and Y is 84; X is 17 and Y is 85; X is 17 and Y is 86; X is 17 and Y is 87; X is 17 and Y is 88; X is 17 and Y is 89; X is 17 and Y is 90; X is 17 and Y is 91; X is 17 and Y is 92; X is 17 and Y is 93; X is 17 and Y is 94; X is 17 and Y is 95; X is 17 and Y is 96; X is 17 and Y is 97; X is 17 and Y is 98; X is 17 and Y is 99; X is 17 and Y is 100; X is 17 and Y is 101; X is 17 and Y is 102; X is 17 and Y is 103; X is 17 and Y is 104; X is 17 and Y is 105; X is 17 and Y is 106; X is 17 and Y is 107; X is 17 and Y is 108; X is 17 and Y is 109; X is 17 and Y is 110; X is 17 and Y is 111; X is 17 and Y is 112; X is 17 and Y is 113; X is 17 and Y is 114; X is 17 and Y is 115; X is 17 and Y is 116; X is 17 and Y is 117; X is 17 and Y is 118; X is 17 and Y is 119; X is 17 and Y is 120; X is 17 and Y is 121; X is 17 and Y is 122; X is 17 and Y is 123; X is 17 and Y is 124; X is 17 and Y is 125; X is 17 and Y is 126; X is 17 and Y is 127; X is 17 and Y is 128; X is 17 and Y is 129; X is 17 and Y is 130; X is 17 and Y is 131; X is 17 and Y is 132; X is 17 and Y is 133; X is 17 and Y is 134; X is 17 and Y is 135; X is 17 and Y is 136; X is 17 and Y is 137; X is 17 and Y is 138; X is 17 and Y is 139; X is 17 and Y is 140; X is 17 and Y is 141; X is 17 and Y is 142; X is 17 and Y is 143; X is 17 and Y is 144; X is 17 and Y is 145; X is 17 and Y is 146; X is 17 and Y is 147; X is 17 and Y is 148; X is 17 and Y is 149; X is 17 and Y is 150; X is 17 and Y is 151; X is 17 and Y is 152; X is 17 and Y is 153; X is 17 and Y is 154; X is 17 and Y is 155; X is 17 and Y is 156; X is 17 and Y is 157; X is 17 and Y is 158; X is 17 and Y is 159; X is 17 and Y is 160; X is 17 and Y is 161; X is 17 and Y is 162; X is 17 and Y is 163; X is 17 and Y is 164; X is 17 and Y is 165; X is 17 and Y is 166; X is 17 and Y is 167; X is 17 and Y is 168; X is 17 and Y is 169; X is 17 and Y is 170; X is 17 and Y is 171; X is 17 and Y is 172; X is 17 and Y is 173; X is 17 and Y is 174; X is 17 and Y is 175; X is 17 and Y is 176; X is 17 and Y is 177; X is 17 and Y is 178; X is 17 and Y is 179; X is 17 and Y is 180; X is 17 and Y is 181; X is 17 and Y is 182; X is 17 and Y is 183; X is 17 and Y is 184; X is 17 and Y is 185; X is 17 and Y is 186;

X is 18 and Y is 1; X is 18 and Y is 2; X is 18 and Y is 3; X is 18 and Y is 4; X is 18 and Y is 5; X is 18 and Y is 6; X is 18 and Y is 7; X is 18 and Y is 8; X is 18 and Y is 9; X is 18 and Y is 10; is 18 and Y is 11; X is 18 and Y is 12; X is 18 and Y is 13; X is 18 and Y is 14; X is 18 and Y is 15; X is 18 and Y is 16; X is 18 and Y is 17; X is 18 and Y is 18; X is 18 and Y is 19; X is 18 and Y is 20; X is 18 and Y is 21; X is 18 and Y is 22; X is 18 and Y is 23; X is 18 and Y is 24; X is 18 and Y is 25; X is 18 and Y is 26; X is 18 and Y is 27; X is 18 and Y is 28; X is 18 and Y is 29; X is 18 and Y is 30; X is 18 and Y is 31; X is 18 and Y is 32; X is 18 and Y is 33; X is 18 and Y is 34; X is 18 and Y is 35; X is 18 and Y is 36; X is 18 and Y is 37; X is 18 and Y is 38; X is 18 and Y is 39; X is 18 and Y is 40; X is 18 and Y is 41; X is 18 and Y is 42; X is 18 and Y is 43; X is 18 and Y is 44; X is 18 and Y is 45; X is 18 and Y is 46; X is 18 and Y is 47; X is 18 and Y is 48; X is 18 and Y is 49; X is 18 and Y is 50; X is 18 and Y is 51; X is 18 and Y is 52; X is 18 and Y is 53; X is 18 and Y is 54; X is 18 and Y is 55; X is 18 and Y is 56; X is 18 and Y is 57; X is 18 and Y is 58; X is 18 and Y is 59; X is 18 and Y is 60; X is 18 and Y is 61; X is 18 and Y is 62; X is 18 and Y is 63; X is 18 and Y is 64; X is 18 and Y is 65; X is 18 and Y is 66; X is 18 and Y is 67; X is 18 and Y is 68; X is 18 and Y is 69; X is 18 and Y is 70; X is 18 and Y is 71; X is 18 and Y is 72; X is 18 and Y is 73; X is 18 and Y is 74; X is 18 and Y is 75; X is 18 and Y is 76; X is 18 and Y is 77; X is 18 and Y is 78; X is 18 and Y is 79; X is 18 and Y is 80; X is 18 and Y is 81; X is 18 and Y is 82; X is 18 and Y is 83; X is 18 and Y is 84; X is 18 and Y is 85; X is 18 and Y is 86; X is 18 and Y is 87; X is 18 and Y is 88; X is 18 and Y is 89; X is 18 and Y is 90; X is 18 and Y is 91; X is 18 and Y is 92; X is 18 and Y is 93; X is 18 and Y is 94; X is 18 and Y is 95; X is 18 and Y is 96; X is 18 and Y is 97; X is 18 and Y is 98; X is 18 and Y is 99; X is 18 and Y is 100; X is 18 and Y is 101; X is 18 and Y is 102; X is 18 and Y is 103; X is 18 and Y is 104; X is 18 and Y is 105; X is 18 and Y is 106; X is 18 and Y is 107; X is 18 and Y is 108; X is 18 and Y is 109; X is 18 and Y is 110; X is 18 and Y is 111; X is 18 and Y is 112; X is 18 and Y is 113; X is 18 and Y is 114; X is 1.8 and Y is 115; X is 18 and Y is 116; X is 18 and Y is 117; X is 18 and Y is 118; X is 18 and Y is 119; X is 18 and Y is 120; X is 18 and Y is 121; X is 18 and Y is 122; X is 18 and Y is 123; X is 18 and Y is 124; X is 18 and Y is 125; X is 18 and Y is 126; X is 18 and Y is 127; X is 18 and Y is 128; X is 18 and Y is 129; X is 18 and Y is 130; X is 18 and Y is 131; X is 18 and Y is 132; X is 18 and Y is 133; X is 18 and Y is 134; X is 18 and Y is 135; X is 18 and Y is 136; X is 18 and Y is 137; X is 18 and Y is 138; X is 18 and Y is 139; X is 18 and Y is 140; X is 18 and Y is 141; X is 18 and Y is 142; X is 18 and Y is 143; X is 18 and Y is 144; X is 18 and Y is 145; X is 18 and Y is 146; X is 18 and Y is 147; X is 18 and Y is 148; X is 18 and Y is 149; X is 18 and Y is 150; X is 18 and Y is 151; X is 18 and Y is 152; X is 18 and Y is 153; X is 18 and Y is 154; X is 18 and Y is 155; X is 18 and Y is 156; X is 18 and Y is 157; X is 18 and Y is 158; X is 18 and Y is 159; X is 18 and Y is 160; X is 18 and Y is 161; X is 18 and Y is 162; X is 18 and Y is 163; X is 18 and Y is 164; X is 18 and Y is 165; X is 18 and Y is 166; X is 18 and Y is 167; X is 18 and Y is 168; X is 18 and Y is 169; X is 18 and Y is 170; X is 18 and Y is 171; X is 18 and Y is 172; X is 18 and Y is 173; X is 18 and Y is 174; X is 18 and Y is 175; X is 18 and Y is 176; X is 18 and Y is 177; X is 18 and Y is 178; X is 18 and Y is 179; X is 18 and Y is 180; X is 18 and Y is 181; X is 18 and Y is 182; X is 18 and Y is 183; X is 18 and Y is 184; X is 18 and Y is 185; X is 18 and Y is 186;

X is 19 and Y is 1; X is 19 and Y is 2; X is 19 and Y is 3; X is 19 and Y is 4; X is 19 and Y is 5; X is 19 and Y is 6; X is 19 and Y is 7; X is 19 and Y is 8; X is 19 and Y is 9; X is 19 and Y is 10; X is 19 and Y is 11; X is 19 and Y is 12; X is 19 and Y is 13; X is 19 and Y is 14; X is 19 and Y is 15; X is 19 and Y is 16; X is 19 and Y is 17; X is 19 and Y is 18; X is 19 and Y is 19; X is 19 and Y is 20; X is 19 and Y is 21; X is 19 and Y is 22; X is 19 and Y is 23; X is 19 and Y is 24; X is 19 and Y is 25; X is 19 and Y is 26; X is 19 and Y is 27; X is 19 and Y is 28; X is 19 and Y is 29; X is 19 and Y is 30; X is 19 and Y is 31; X is 19 and Y is 32; X is 19 and Y is 33; X is 19 and Y is 34; X is 19 and Y is 35; X is 19 and Y is 36; X is 19 and Y is 37; X is 19 and Y is 38; X is 19 and Y is 39; X is 19 and Y is 40; X is 19 and Y is 41; X is 19 and Y is 42; X is 19 and Y is 43; X is 19 and Y is 44; X is 19 and Y is 45; X is 19 and Y is 46; X is 19 and Y is 47; X is 19 and Y is 48; X is 19 and Y is 49; X is 19 and Y is 50; X is 19 and Y is 51; X is 19 and Y is 52; X is 19 and Y is 53; X is 19 and Y is 54; X is 19 and Y is 55; X is 19 and Y is 56; X is 19 and Y is 57; X is 19 and Y is 58; X is 19 and Y is 59; X is 19 and Y is 60; X is 19 and Y is 61; X is 19 and Y is 62; X is 19 and Y is 63; X is 19 and Y is 64; X is 19 and Y is 65; X is 19 and Y is 66; X is 19 and Y is 67; X is 19 and Y is 68; X is 19 and Y is 69; X is 19 and Y is 70; X is 19 and Y is 71; X is 19 and Y is 72; X is 19 and Y is 73; X is 19 and Y is 74; X is 19 and Y is 75; X is 19 and Y is 76; X is 19 and Y is 77; X is 19 and Y is 78; X is 19 and Y is 79; X is 19 and Y is 80; X is 19 and Y is 81; X is 19 and Y is 82; X is 19 and Y is 83; X is 19 and Y is 84; X is 19 and Y is 85; X is 19 and Y is 86; X is 19 and Y is 87; X is 19 and Y is 88; X is 19 and Y is 89; X is 19 and Y is 90; X is 19 and Y is 91; X is 19 and Y is 92; X is 19 and Y is 93; X is 19 and Y is 94; X is 19 and Y is 95; X is 19 and Y is 96; X is 19 and Y is 97; X is 19 and Y is 98; X is 19 and Y is 99; X is 19 and Y is 100; X is 19 and Y is 101; X is 19 and Y is 102; X is 19 and Y is 103; X is 19 and Y is 104; X is 19 and Y is 105; X is 19 and Y is 106; X is 19 and Y is 107; X is 19 and Y is 108; X is 19 and Y is 109; X is 19 and Y is 110; X is 19 and Y is 111; X is 19 and Y is 112; X is 19 and Y is 113; X is 19 and Y is 114; X is 19 and Y is 115; X is 19 and Y is 116; X is 19 and Y is 117; X is 19 and Y is 118; X is 19 and Y is 119; X is 19 and Y is 120; X is 19 and Y is 121; X is 19 and Y is 122; X is 19 and Y is 123; X is 19 and Y is 124; X is 19 and Y is 125; X is 19 and Y is 126; X is 19 and Y is 127; X is 19 and Y is 128; X is 19 and Y is 129; X is 19 and Y is 130; X is 19 and Y is 131; X is 19 and Y is 132; X is 19 and Y is 133; X is 19 and Y is 134; X is 19 and Y is 135; X is 19 and Y is 136; X is 19 and Y is 137; X is 19 and Y is 138; X is 19 and Y is 139; X is 19 and Y is 140; X is 19 and Y is 141; X is 19 and Y is 142; X is 19 and Y is 143; X is 19 and Y is 144; X is 19 and Y is 145; X is 19 and Y is 146; X is 19 and Y is 147; X is 19 and Y is 148; X is 19 and Y is 149; X is 19 and Y is 150; X is 19 and Y is 151; X is 19 and Y is 152; X is 19 and Y is 153; X is 19 and Y is 154; X is 19 and Y is 155; X is 19 and Y is 156; X is 19 and Y is 157; X is 19 and Y is 158; X is 19 and Y is 159; X is 19 and Y is 160; X is 19 and Y is 161; X is 19 and Y is 162; X is 19 and Y is 163; X is 19 and Y is 164; X is 19 and Y is 165; X is 19 and Y is 166; X is 19 and Y is 167; X is 19 and Y is 168; X is 19 and Y is 169; X is 19 and Y is 170; X is 19 and Y is 171; X is 19 and Y is 172; X is 19 and Y is 173; X is 19 and Y is 174; X is 19 and Y is 175; X is 19 and Y is 176; X is 19 and Y is 177; X is 19 and Y is 178; X is 19 and Y is 179; X is 19 and Y is 180; X is 19 and Y is 181; X is 19 and Y is 182; X is 19 and Y is 183; X is 19 and Y is 184; X is 19 and Y is 185; X is 19 and Y is 186; X is 20 and Y is 1; X is 20 and Y is 2; X is 20 and Y is 3; X is 20 and Y is 4; X is 20 and Y is 5; X is 20 and Y is 6; X is 20 and Y is 7; X is 20 and Y is 8; X is 20 and Y is 9; X is 20 and Y is 10; X is 20 and Y is 11; X is 20 and Y is 12; X is 20 and Y is 13; X is 20 and Y is 14; X is 20 and Y is 15; X is 20 and Y is 16; X is 20 and Y is 17; X is 20 and Y is 18; X is 20 and Y is 19; X is 20 and Y is 20; X is 20 and Y is 21; X is 20 and Y is 22; X is 20 and Y is 23; X is 20 and Y is 24; X is 20 and Y is 25; X is 20 and Y is 26; X is 20 and Y is 27; X is 20 and Y is 28; X is 20 and Y is 29; X is 20 and Y is 30; X is 20 and Y is 31; X is 20 and Y is 32; X is 20 and is 33; X is 20 and Y is 34; X is 20 and Y is 35; X is 20 and Y is 36; X is 20 and Y is 37; X is 20 and Y is 38; X is 20 and Y is 39; X is 20 and Y is 40; X is 20 and Y is 41; X is 20 and Y is 42; X is 20 and Y is 43; X is 20 and Y is 44; X is 20 and Y is 45; X is 20 and Y is 46; X is 20 and Y is 47; X is 20 and Y is 48; X is 20 and Y is 49; X is 20 and Y is 50; X is 20 and Y is 51; X is 20 and Y is 52; X is 20 and Y is 53; X is 20 and Y is 54; X is 20 and Y is 55; X is 20 and Y is 56; X is 20 and Y is 57; X is 20 and Y is 58; X is 20 and Y is 59; X is 20 and Y is 60; X is 20 and Y is 61; X is 20 and Y is 62; X is 20 and Y is 63; X is 20 and Y is 64; X is 20 and Y is 65; X is 20 and Y is 66; X is 20 and Y is 67; X is 20 and Y is 68; X is 20 and Y is 69; X is 20 and Y is 70; X is 20 and Y is 71; X is 20 and Y is 72; X is 20 and Y is 73; X is 20 and Y is 74; X is 20 and Y is 75; X is 20 and Y is 76; X is 20 and Y is 77; X is 20 and Y is 78; X is 20 and Y is 79; X is 20 and Y is 80; X is 20 and Y is 81; X is 20 and Y is 82; X is 20 and Y is 83; X is 20 and Y is 84; X is 20 and Y is 85; X is 20 and Y is 86; X is 20 and Y is 87; X is 20 and Y is 88; X is 20 and Y is 89; X is 20 and Y is 90; X is 20 and Y is 91; X is 20 and Y is 92; X is 20 and Y is 93; X is 20 and Y is 94; X is 20 and Y is 95; X is 20 and Y is 96; X is 20 and Y is 97; X is 20 and Y is 98; X is 20 and Y is 99; X is 20 and Y is 100; X is 20 and Y is 101; X is 20 and Y is 102; X is 20 and Y is 103; X is 20 and Y is 104; X is 20 and Y is 105; X is 20 and Y is 106; X is 20 and Y is 107; X is 20 and Y is 108; X is 20 and Y is 109; X is 20 and Y is 110; X is 20 and Y is 111; X is 20 and Y is 112; X is 20 and Y is 113; X is 20 and Y is 114; X is 20 and Y is 115; X is 20 and Y is 116; X is 20 and Y is 117; X is 20 and Y is 118; X is 20 and Y is 119; X is 20 and Y is 120; X is 20 and Y is 121; X is 20 and Y is 122; X is 20 and Y is 123; X is 20 and Y is 124; X is 20 and Y is 125; X is 20 and Y is 126; X is 20 and Y is 127; X is 20 and Y is 128; X is 20 and Y is 129; X is 20 and Y is 130; X is 20 and Y is 131; X is 20 and Y is 132; X is 20 and Y is 133; X is 20 and Y is 134; X is 20 and Y is 135; X is 20 and Y is 136; X is 20 and Y is 137; X is 20 and Y is 138; X is 20 and Y is 139; X is 20 and Y is 140; X is 20 and Y is 141; X is 20 and Y is 142; X is 20 and Y is 143; X is 20 and Y is 144; X is 20 and Y is 145; X is 20 and Y is 146; X is 20 and Y is 147; X is 20 and Y is 148; X is 20 and Y is 149; X is 20 and Y is 150; X is 20 and Y is 151; X is 20 and Y is 152; X is 20 and Y is 153; X is 20 and Y is 154; X is 20 and Y is 155; X is 20 and Y is 156; X is 20 and Y is 157; X is 20 and Y is 158; X is 20 and Y is 159; X is 20 and Y is 160; X is 20 and Y is 161; X is 20 and Y is 162; X is 20 and Y is 163; X is 20 and Y is 164; X is 20 and Y is 165; X is 20 and Y is 166; X is 20 and Y is 167; X is 20 and Y is 168; X is 20 and Y is 169; X is 20 and Y is 170; X is 20 and Y is 171; X is 20 and Y is 172; X is 20 and Y is 173; X is 20 and Y is 174; X is 20 and Y is 175; X is 20 and Y is 176; X is 20 and Y is 177; X is 20 and Y is 178; X is 20 and Y is 179; X is 20 and Y is 180; X is 20 and Y is 181; X is 20 and Y is 182; X is 20 and Y is 183; X is 20 and Y is 184; X is 20 and Y is 185; X is 20 and Y is 186;
X is 21 and Y is 1; X is 21 and Y is 2; X is 21 and Y is 3; X is 21 and Y is 4; X is 21 and Y is 5; X is 21 and Y is 6; X is 21 and Y is 7; X is 21 and Y is 8; X is 21 and Y is 9; X is 21 and Y is 10; X is 21 and Y is 11; X is 21 and Y is 12; X is 21 and Y is 13; X is 21 and Y is 14; X is 21 and Y is 15; X is 21 and Y is 16; X is 21 and Y is 17; X is 21 and Y is 18; X is 21 and Y is 19; X is 21 and Y is 20; X is 21 and Y is 21; X is 21 and Y is 22; X is 21 and Y is 23; X is 21 and Y is 24; X is 21 and Y is 25; X is 21 and Y is 26; X is 21 and Y is 27; X is 21 and Y is 28; X is 21 and Y is 29; X is 21 and Y is 30; X is 21 and Y is 31; X is 21 and Y is 32; X is 21 and Y is 33; X is 21 and Y is 34; X is 21 and Y is 35; X is 21 and Y is 36; X is 21 and Y is 37; X is 21 and Y is 38; X is 21 and Y is 39; X is 21 and Y is 40; X is 21 and Y is 41; X is 21 and Y is 42; X is 21 and Y is 43; X is 21 and Y is 44; X is 21 and Y is 45; X is 21 and Y is 46; X is 21 and Y is 47; X is 21 and Y is 48; X is 21 and Y is 49; X is 21 and Y is 50; X is 21 and Y is 51; X is 21 and Y is 52; X is 21 and Y is 53; X is 21 and Y is 54; X is 21 and Y is 55; X is 21 and Y is 56; X is 21 and Y is 57; X is 21 and Y is 58; X is 21 and Y is 59; X is 21 and Y is 60; X is 21 and Y is 61; X is 21 and Y is 62; X is 21 and Y is 63; X is 21 and Y is 64; X is 21 and Y is 65; X is 21 and Y is 66; X is 21 and Y is 67; X is 21 and Y is 68; X is 21 and Y is 69; X is 21 and Y is 70; X is 21 and Y is 71; X is 21 and Y is 72; X is 21 and Y is 71; X is 21 and NT is 74; X is 21 and Y is 75; X is 21 and Y is 76; X is 21 and Y is 77; X is 21 and Y is 78; X is 21 and Y is 79; X is 21 and Y is 80; X is 21 and Y is 81; X is 21 and Y is 82; X is 21 and Y is 83; X is 21 and Y is 84; X is 21 and Y is 85; X is 21 and Y is 86; X is 21 and Y is 87; X is 21 and Y is 88; X is 21 and Y is 89; X is 21 and Y is 90; X is 21 and Y is 91; X is 21 and Y is 92; X is 21 and Y is 93; X is 21 and Y is 94; X is 21 and Y is 95; X is 21 and Y is 96; X is 21 and Y is 97; X is 21 and Y is 98; X is 21 and Y is 99; X is 21 and Y is 100; X is 21 and Y is 101; X is 21 and Y is 102; X is 21 and Y is 103; X is 21 and Y is 104; X is 21 and Y is 105; X is 21 and Y is 106; X is 21 and Y is 107; X is 21 and Y is 108; X is 21 and Y is 109; X is 21 and Y is 110; X is 21 and Y is 111; X is 21 and Y is 112; X is 21 and Y is 113; X is 21 and Y is 114; X is 21 and Y is 115; X is 21 and Y is 116; X is 21 and Y is 117; X is 21 and Y is 118; X is 21 and Y is 119; X is 21 and Y is 120; X is 21 and Y is 121; X is 21 and Y is 122; X is 21 and Y is 123; X is 21 and Y is 124; X is 21 and Y is 125; X is 21 and Y is 126; X is 21 and Y is 127; X is 21 and Y is 128; X is 21 and Y is 129; X is 21 and Y is 130; X is 21 and Y is 131; X is 21 and Y is 132; X is 21 and Y is 133; X is 21 and Y is 134; X is 21 and Y is 135; X is 21 and Y is 136; X is 21 and Y is 137; X is 21 and Y is 138; X is 21 and Y is 139; X is 21 and Y is 140; X is 21 and Y is 141; X is 21 and Y is 142; X is 21 and Y is 143; X is 21 and Y is 144; X is 21 and Y is 145; X is 21 and Y is 146; X is 21 and Y is 147; X is 21 and Y is 148; X is 21 and Y is 149; X is 21 and Y is 150; X is 21 and Y is 151; X is 21 and Y is 152; X is 21 and Y is 153; X is 21 and Y is 154; X is 21 and Y is 155; X is 21 and Y is 156; X is 21 and Y is 157; X is 21 and Y is 158; X is 21 and Y is 159; X is 21 and Y is 160; X is 21 and Y is 161; X is 21 and Y is 162; X is 21 and Y is 163; X is 21 and Y is 164; X is 21 and Y is 165; X is 21 and Y is 166; X is 21 and Y is 167; X is 21 and Y is 168; X is 21 and Y is 169; X is 21 and Y is 170; X is 21 and Y is 171; X is 21 and Y is 172; X is 21 and Y is 173; X is 21 and Y is 174; X is 21 and Y is 175; X is 21 and Y is 176; X is 21 and Y is 177; X is 21 and Y is 178; X is 21 and Y is 179; X is 21 and Y is 180; X is 21 and Y is 181; X is 21 and Y is 182; X is 21 and Y is 183; X is 21 and Y is 184; X is 21 and Y is 185; X is 21 and Y is 186; X is 22 and Y is 1; X is 22 and Y is 2; X is 22 and Y is 3; X is 22 and Y is 4; X is 22 and Y is 5; X is 22 and Y is 6; X is 22 and Y is 7; X is 22 and Y is 8; X is 22 and Y is 9; X is 22 and Y is 10; X is 22 and Y is 11; X is 22 and Y is 12; X is 22 and Y is 13; X is 22 and Y is 14; X is 22 and Y is 15; X is 22 and Y is 16; X is 22 and Y is 17; X is 22 and Y is 18; X is 22 and Y is 19; X is 22 and Y is 20; X is 22 and Y is 21; X is 22 and Y is 22; X is 22 and Y is 23; X is 22 and Y is 24; X is 22 and Y is 25; X is 22 and Y is 26; X is 22 and Y is 27; X is 22 and Y is 28; X is 22 and Y is 29; X is 22 and Y is 30; X is 22 and Y is 31; X is 22 and Y is 32; X is 22 and Y is 33; X is 22 and Y is 34; X is 22 and Y is 35; X is 22 and Y is 36; X is 22 and Y is 37; X is 22 and Y is 38; X is 22 and Y is 39; X is 22 and Y is 40; X is 22 and Y is 41; X is 22 and Y is 42; X is 22 and Y is 43; X is 22 and Y is 44; X is 22 and Y is 45; X is 22 and Y is 46; X is 22 and Y is 47; X is 22 and Y is 48; X is 22 and Y is 49; X is 22 and Y is 50; X is 22 and Y is 51; X is 22 and Y is 52; X is 22 and Y is 53; X is 22 and Y is 54; X is 22 and Y is 55; X is 22 and Y is 56; X is 22 and Y is 57; X is 22 and Y is 58; X is 22 and Y is 59; X is 22 and Y is 60; X is 22 and Y is 61; X is 22 and Y is 62; X is 22 and Y is 63; X is 22 and Y is 64; X is 22 and Y is 65; X is 22 and Y is 66; X is 22 and Y is 67; X is 22 and Y is 68; X is 22 and Y is 69; X is 22 and Y is 70; X is 22 and Y is 71; X is 22 and Y is 72; X is 22 and Y is 73; X is 22 and Y is 74; X is 22 and Y is 75; X is 22 and Y is 76; X is 22 and Y is 77; X is 22 and Y is 78; X is 22 and Y is 79; X is 22 and Y is 80; X is 22 and Y is 81; X is 22 and Y is 82; X is 22 and Y is 83; X is 22 and Y is 84; X is 22 and Y is 85; X is 22 and Y is 86; X is 22 and Y is 87; X is 22 and Y is 88; X is 22 and Y is 89; X is 22 and Y is 90; X is 22 and Y is 91; X is 22 and Y is 92; X is 22 and Y is 93; X is 22 and Y is 94; X is 22 and Y is 95; X is 22 and Y is 96; X is 22 and Y is 97; X is 22 and Y is 98; X is 22 and Y is 99; X is 22 and Y is 100; X is 22 and Y is 101; X is 22 and Y is 102; X is 22 and Y is 103; X is 22 and Y is 104; X is 22 and Y is 105; X is 22 and Y is 106; X is 22 and Y is 107; X is 22 and Y is 108; X is 22 and Y is 109; X is 22 and Y is 110; X is 22 and Y is 111; X is 22 and Y is 112; X is 22 and Y is 113; X is 22 and Y is 114; X is 22 and Y is 115; X is 22 and Y is 116; X is 22 and Y is 117; X is 22 and Y is 118; X is 22 and Y is 119; X is 22 and Y is 120; X is 22 and Y is 121; X is 22 and Y is 122; X is 22 and Y is 123; X is 22 and Y is 124; X is 22 and Y is 125; X is 22 and Y is 126; X is 22 and Y is 127; X is 22 and Y is 128; X is 22 and Y is 129; X is 22 and Y is 130; X is 22 and Y is 131; X is 22 and Y is 132; X is 22 and Y is 133; X is 22 and Y is 134; X is 77 and Y is 135; X is 22 and Y is 136; X is 22 and Y is 137; X is 22 and Y is 138; X is 22 and Y is 139; X is 22 and Y is 140; X is 22 and Y is 141; X is 22 and Y is 142; X is 22 and Y is 143; X is 22 and Y is 144; X is 22 and Y is 145; X is 22 and Y is 146; X is 22 and Y is 147; X is 22 and Y is 148; X is 22 and Y is 149; X is 22 and Y is 150; X is 22 and Y is 151; X is 22 and Y is 152; X is 22 and Y is 153; X is 22 and Y is 154; X is 22 and Y is 155; X is 22 and Y is 156; X is 22 and Y is 157; X is 22 and Y is 158; X is 22 and Y is 159; X is 22 and Y is 160; X is 22 and Y is 161; X is 22 and Y is 162; X is 22 and Y is 163; X is 22 and Y is 164; X is 22 and Y is 165; X is 22 and Y is 166; X is 22 and Y is 167; X is 22 and Y is 168; X is 22 and Y is 169; X is 22 and Y is 170; X is 22 and Y is 171; X is 22 and Y is 172; X is 22 and Y is 173; X is 22 and Y is 174; X is 22 and Y is 175; X is 22 and Y is 176; X is 22 and Y is 177; X is 22 and Y is 178; X is 22 and Y is 179; X is 22 and Y is 180; X is 22 and Y is 181; X is 22 and Y is 182; X is 22 and Y is 183; X is 22 and Y is 184; X is 22 and Y is 185; X is 22 and Y is 186; X is 23 and Y is 1; X is 23 and Y is 2; X is 23 and Y is 3; X is 23 and Y is 4; X is 23 and Y is 5; X is 23 and Y is 6; X is 23 and Y is 7; X is 23 and Y is 8; X is 23 and Y is 9; X is 23 and Y is 10; X is 23 and Y is 11; X is 23 and Y is 12; X is 23 and Y is 13; X is 23 and Y is 14; X is 23 and Y is 15; X is 23 and Y is 16; X is 23 and Y is 17; X is 23 and Y is 18; X is 23 and Y is 19; X is 23 and Y is 20; X is 23 and Y is 21; X is 23 and Y is 22; X is 23 and Y is 23; X is 23 and Y is 24; X is 23 and Y is 25; X is 23 and Y is 26; X is 23 and Y is 27; X is 23 and Y is 28; X is 23 and Y is 29; X is 23 and Y is 30; X is 23 and Y is 31; X is 23 and Y is 32; X is 23 and Y is 33; X is 23 and Y is 34; X is 23 and Y is 35; X is 23 and Y is 36; X is 23 and Y is 37; X is 23 and Y is 38; X is 23 and Y is 39; X is 23 and Y is 40; X is 23 and Y is 41; X is 23 and Y is 42; X is 23 and Y is 43; X is 23 and Y is 44; X is 23 and Y is 45; X is 23 and Y is 46; X is 23 and Y is 47; X is 23 and Y is 48; X is 23 and Y is 49; X is 23 and Y is 50; X is 23 and Y is 51; X is 23 and Y is 52; X is 23 and Y is 53; X is 23 and Y is 54; X is 23 and Y is 55; X is 23 and Y is 56; X is 23 and Y is 57; X is 23 and Y is 58; X is 23 and Y is 59; X is 23 and Y is 60; X is 23 and Y is 61; X is 23 and Y is 62; X is 23 and Y is 63; X is 23 and Y is 64; X is 23 and Y is 65; X is 23 and Y is 66; X is 23 and Y is 67; X is 23 and Y is 68; X is 23 and Y is 69; X is 23 and Y is 70; X is 23 and Y is 71; X is 23 and Y is 72; X is 23 and Y is 73; X is 23 and Y is 74; X is 23 and Y is 75; X is 23 and Y is 76; X is 23 and Y is 77; X is 23 and Y is 78; X is 23 and Y is 79; X is 23 and Y is 80; X is 23 and Y is 81; X is 23 and Y is 82; X is 23 and Y is 83; X is 23 and Y is 84; X is 23 and Y is 85; X is 23 and Y is 86; X is 23 and Y is 87; X is 23 and Y is 88; X is 23 and Y is 89; X is 23 and Y is 90; X is 23 and Y is 91; X is 23 and Y is 92; X is 23 and Y is 93; X is 23 and Y is 94; X is 23 and Y is 95; X is 23 and Y is 96; X is 23 and Y is 97; X is 23 and Y is 98; X is 23 and Y is 99; X is 23 and Y is 100; X is 23 and Y is 101; X is 23 and Y is 102; X is 23 and Y is 103; X is 23 and Y is 104; X is 23 and Y is 105; X is 23 and Y is 106; X is 23 and Y is 107; X is 23 and Y is 108; X is 23 and Y is 109; X is 23 and Y is 110; X is 23 and Y is 111; X is 23 and Y is 112; X is 23 and Y is 113; X is 23 and Y is 114; X is 23 and Y is 115; X is 23 and Y is 116; X is 23 and Y is 117; X is 23 and Y is 118; X is 23 and Y is 119; X is 23 and Y is 120; X is 23 and Y is 121; X is 23 and Y is 122; X is 23 and Y is 123; X is 23 and Y is 124; X is 23 and Y is 125; X is 93 and Y is 126; X is 23 and Y is 127; X is 23 and Y is 128; X is 23 and Y is 129; X is 23 and Y is 130; X is 23 and Y is 131; X is 23 and Y is 132; X is 23 and Y is 133; X is 23 and Y is 134; X is 23 and Y is 135; X is 23 and Y is 136; X is 23 and Y is 137; X is 23 and Y is 138; X is 23 and Y is 139; X is 23 and Y is 140; X is 23 and Y is 141; X is 23 and Y is 142; X is 23 and Y is 143; X is 23 and Y is 144; X is 23 and Y is 145; X is 23 and Y is 146; X is 23 and Y is 147; X is 23 and Y is 148; X is 23 and Y is 149; X is 23 and Y is 150; X is 23 and Y is 151; X is 23 and Y is 152; X is 23 and Y is 153; X is 23 and Y is 154; X is 23 and Y is 155; X is 23 and Y is 156; X is 23 and Y is 157; X is 23 and Y is 158; X is 23 and Y is 159; X is 23 and Y is 160; X is 23 and Y is 161; X is 23 and Y is 162; X is 23 and Y is 163; X is 23 and Y is 164; X is 23 and Y is 165; X is 23 and Y is 166; X is 23 and Y is 167; X is 23 and Y is 168; X is 23 and Y is 169; X is 23 and Y is 170; X is 23 and Y is 171; X is 23 and Y is 172; X is 23 and Y is 173; X is 23 and Y is 174; X is 23 and Y is 175; X is 23 and Y is 176; X is 23 and Y is 177; X is 23 and Y is 178; X is 23 and Y is 179; X is 23 and Y is 180; X is 23 and Y is 181; X is 23 and Y is 182; X is 23 and Y is 183; X is 23 and Y is 184; X is 23 and Y is 185; X is 23 and Y is 186;
X is 24 and Y is 1; X is 24 and Y is 2; X is 24 and Y is 3; X is 24 and Y is 4; X is 24 and Y is 5; X is 24 and Y is 6; X is 24 and Y is 7; X is 24 and Y is 8; X is 24 and Y is 9; X is 24 and Y is 10; X is 24 and Y is 11; X is 24 and Y is 12; X is 24 and Y is 13; X is 24 and Y is 14; X is 24 and Y is 15; X is 24 and Y is 16; X is 24 and Y is 17; X is 24 and Y is 18; X is 24 and Y is 19; X is 24 and Y is 20; X is 24 and Y is 21; X is 24 and Y is 22; X is 24 and Y is 23; X is 24 and Y is 24; X is 24 and Y is 25; X is 24 and Y is 26; X is 24 and Y is 27; X is 24 and Y is 28; X is 24 and Y is 29; X is 24 and Y is 30; X is 24 and Y is 31; X is 24 and Y is 32; X is 24 and Y is 33; X is 24 and Y is 34; X is 24 and Y is 35; X is 24 and Y is 36; X is 24 and Y is 37; X is 24 and Y is 38; X is 24 and Y is 39; X is 24 and Y is 40; X is 24 and Y is 41; X is 24 and Y is 42; X is 24 and Y is 43; X is 24 and Y is 44; X is 24 and Y is 45; X is 24 and Y is 46; X is 24 and Y is 47; X is 24 and Y is 48; X is 24 and Y is 49; X is 24 and Y is 50; X is 24 and Y is 51; X is 24 and Y is 52; X is 24 and Y is 53; X is 24 and Y is 54; X is 24 and Y is 55; X is 24 and Y is 56; X is 24 and Y is 57; X is 24 and Y is 58; X is 24 and Y is 59; X is 24 and Y is 60; X is 24 and Y is 61; X is 24 and Y is 62; X is 24 and Y is 63; X is 24 and Y is 64; X is 24 and Y is 65; X is 24 and Y is 66; X is 24 and Y is 67; X is 24 and Y is 68; X is 24 and Y is 69; X is 24 and Y is 70; X is 24 and Y is 71; X is 24 and Y is 72; X is 24 and Y is 73; X is 24 and Y is 74; X is 24 and Y is 75; X is 24 and Y is 76; X is 24 and Y is 77; X is 24 and Y is 78; X is 24 and Y is 79; X is 24 and Y is 80; X is 24 and Y is 81; X is 24 and Y is 82; X is 24 and Y is 83; X is 24 and Y is 84; X is 24 and Y is 85; X is 24 and Y is 86; X is 24 and Y is 87; X is 24 and Y is 88; X is 24 and Y is 89; X is 24 and Y is 90; X is 24 and Y is 91; X is 24 and Y is 92; X is 24 and Y is 93; X is 24 and Y is 94; X is 24 and Y is 95; X is 24 and Y is 96; X is 24 and Y is 97; X is 24 and Y is 98; X is 24 and Y is 99; X is 24 and Y is 100; X is 24 and Y is 101; X is 24 and Y is 102; X is 24 and Y is 103; X is 24 and Y is 104; X is 24 and Y is 105; X is 24 and Y is 106; X is 24 and Y is 107; X is 24 and Y is 108; X is 24 and Y is 109; X is 24 and Y is 110; X is 24 and Y is 111; X is 24 and Y is 112; X is 24 and Y is 113; X is 24 and Y is 114; X is 24 and Y is 115; X is 7.4 and Y is 116; X is 24 and Y is 117; X is 24 and Y is 118; X is 24 and Y is 119; X is 24 and Y is 120; X is 24 and Y is 121; X is 24 and Y is 122; X is 24 and Y is 123; X is 24 and Y is 124; X is 24 and Y is 125; X is 24 and Y is 126; X is 24 and Y is 127; X is 24 and Y is 128; X is 24 and Y is 129; X is 24 and Y is 130; X is 24 and Y is 131; X is 24 and Y is 132; X is 24 and Y is 133; X is 24 and Y is 134; X is 24 and Y is 135; X is 24 and Y is 136; X is 24 and Y is 137; X is 24 and Y is 138; X is 24 and Y is 139; X is 24 and Y is 140; X is 24 and Y is 141; X is 24 and Y is 142; X is 24 and Y is 143; X is 24 and Y is 144; X is 24 and Y is 145; X is 24 and Y is 146; X is 24 and Y is 147; X is 24 and Y is 148; X is 24 and Y is 149; X is 24 and Y is 150; X is 24 and Y is 151; X is 24 and Y is 152; X is 24 and Y is 153; X is 24 and Y is 154; X is 24 and Y is 155; X is 24 and Y is 156; X is 24 and Y is 157; X is 24 and Y is 158; X is 24 and Y is 159; X is 24 and Y is 160; X is 24 and Y is 161; X is 24 and Y is 162; X is 24 Y is 163; X is 24 and Y is 164; X is 24 Y is 165; X is 24 and Y is 166; X is 24 and Y is 167; X is 24 and Y is 168; X is 24 and Y is 169; X is 24 and Y is 170; X is 24 and Y is 171; X is 24 and Y is 172; X is 24 and Y is 173; X is 24 and Y is 174; X is 24 and Y is 175; X is 24 and Y is 176; X is 24 and Y is 177; X is 24 and Y is 178; X is 24 and Y is 179; X is 24 and Y is 180; X is 24 and Y is 181; X is 24 and Y is 182; X is 24 and Y is 183; X is 24 and Y is 184; X is 24 and Y is 185; X is 24 and Y is 186;
X is 25 and Y is 1; X is 25 and Y is 2; X is 25 and Y is 3; X is 25 and Y is 4; X is 25 and Y is 5; X is 25 and Y is 6; X is 25 and Y is 7; X is 25 and Y is 8; X is 25 and Y is 9; X is 25 and Y is 10; X is 25 and Y is 11; X is 25 and Y is 12; X is 25 and Y is 13; X is 25 and Y is 14; X is 25 and Y is 15; X is 25 and Y is 16; X is 25 and Y is 17; X is 25 and Y is 18; X is 25 and Y is 19; X is 25 and Y is 20; X is 25 and Y is 21; X is 25 and Y is 22; X is 25 and Y is 23; X is 25 and Y is 24; X is 25 and Y is 25; X is 25 and Y is 26; X is 25 and y is 27; X is 25 and Y is 28; X is 25 and Y is 29; X is 25 and Y is 30; X is 25 and Y is 31; X is 25 and Y is 32; X is 25 and Y is 33; X is 25 and Y is 34; X is 25 and Y is 35; X is 25 and Y is 36; X is 25 and Y is 37; X is 25 and Y is 38; X is 25 and Y is 39; X is 25 and Y is 40; X is 25 and Y is 41; X is 25 and Y is 42; X is 25 and Y is 43; X is 25 and Y is 44; X is 25 and Y is 45; X is 25 and Y is 46; X is 25 and Y is 47; X is 25 and Y is 48; X is 25 and Y is 49; X is 25 and Y is 50; X is 25 and Y is 51; X is 25 and Y is 52; X is 25 and Y is 53; X is 25 and Y is 54; X is 25 and Y is 55; X is 25 and Y is 56; X is 25 and Y is 57; X is 25 and Y is 58; X is 25 and Y is 59; X is 25 and Y is 60; X is 25 and Y is 61; X is 25 and Y is 62; X is 25 and Y is 63; X is 25 and Y is 64; X is 25 and Y is 65; X is 25 and Y is 66; X is 25 and Y is 67; X is 25 and Y is 68; X is 25 and Y is 69; X is 25 and Y is 70; X is 25 and Y is 71; X is 25 and Y is 72; X is 25 and Y is 73; X is 25 and Y is 74; X is 25 and Y is 75; X is 25 and Y is 76; X is 25 and Y is 77; X is 25 and Y is 78; X is 25 and Y is 79; X is 25 and Y is 80; X is 25 and Y is 81; X is 25 and Y is 82; X is 25 and Y is 83; X is 25 and Y is 84; X is 25 and Y is 85; X is 25 and Y is 86; X is 25 and Y is 87; X is 25 and Y is 88; X is 25 and Y is 89; X is 25 and Y is 90; X is 25 and Y is 91; X is 25 and Y is 92; X is 25 and Y is 93; X is 25 and Y is 94; X is 25 and Y is 95; X is 25 and Y is 96; X is 25 and Y is 97; X is 25 and Y is 98; X is 25 and Y is 99; X is 25 and Y is 100; X is 25 and Y is 101; X is 25 and Y is 102; X is 25 and Y is 103; X is 25 and Y is 104; X is 25 and Y is 105; X is 25 and Y is 106; X is 25 and Y is 107; X is 25 and Y is 108; X is 25 and Y is 109; X is 25 and Y is 110; X is 25 and Y is 111; X is 25 and Y is 112; X is 25 and Y is 113; X is 25 and Y is 114; X is 25 and Y is 115; X is 25 and Y is 116; X is 25 and Y is 117; X is 25 and Y is 118; X is 25 and Y is 119; X is 25 and Y is 120; X is 25 and Y is 121; X is 25 and Y is 122; X is 25 and Y is 123; X is 25 and Y is 124; X is 25 and Y is 125; X is 25 and Y is 126; X is 25 and Y is 127; X is 25 and Y is 128; X is 25 and Y is 129; X is 25 and Y is 130; X is 25 and Y is 131; X is 25 and Y is 132; X is 25 and Y is 133; X is 25 and Y is 134; X is 25 and Y is 135; X is 25 and Y is 136; X is 25 and Y is 137; X is 25 and Y is 138; X is 25 and Y is 139; X is 25 and Y is 140; X is 25 and Y is 141; X is 25 and Y is 142; X is 25 and Y is 143; X is 25 and Y is 144; X is 25 and Y is 145; X is 25 and Y is 146; X is 25 and Y is 147; X is 25 and Y is 148; X is 25 and Y is 149; X is 25 and Y is 150; X is 25 and Y is 151; X is 25 and Y is 152; X is 25 and Y is 153; X is 25 and Y is 154; X is 25 and Y is 155; X is 25 and Y is 156; X is 25 and Y is 157; X is 25 and Y is 158; X is 25 and Y is 159; X is 25 and Y is 160; X is 25 and Y is 161; X is 25 and Y is 162; X is 25 and Y is 163; X is 25 and Y is 164; X is 25 and Y is 165; X is 25 and Y is 166; X is 25 and Y is 167; X is 25 and Y is 168; X is 25 and Y is 169; X is 25 and Y is 170; X is 25 and Y is 171; X is 25 and Y is 172; X is 25 and Y is 173; X is 25 and Y is 174; X is 25 and Y is 175; X is 25 and Y is 176; X is 25 and Y is 177; X is 25 and Y is 178; X is 25 and Y is 179; X is 25 and Y is 180; X is 25 and Y is 181; X is 25 and Y is 182; X is 25 and Y is 183; X is 25 and Y is 184; X is 25 and Y is 185; X is 25 and Y is 186;
X is 26 and Y is 1; X is 26 and Y is 2; X is 26 and Y is 3; X is 26 and Y is 4; X is 26 and Y is 5; X is 26 and Y is 6; X is 26 and Y is 7; X is 26 and Y is 8; X is 26 and Y is 9; X is 26 and Y is 10; X is 26 and Y is 11; X is 26 and Y is 12; X is 26 and Y is 13; X is 26 and Y is 14; X is 26 and Y is 15; X is 26 and Y is 16; X is 26 and Y is 17; X is 26 and Y is 18; X is 26 and Y is 19; X is 26 and Y is 20; X is 26 and Y is 21; X is 26 and Y is 22; X is 26 and Y is 23; X is 26 and Y is 24; X is 26 and Y is 25; X is 26 and Y is 26; X is 26 and Y is 27; X is 26 and Y is 28; X is 26 and Y is 29; X is 26 and Y is 30; X is 26 and Y is 31; X is 26 and Y is 32; X is 26 and Y is 33; X is 26 and Y is 34; X is 26 and Y is 35; X is 26 and Y is 36; X is 26 and Y is 37; X is 26 and Y is 38; X is 26 and Y is 39; X is 26 and Y is 40; X is 26 and Y is 41; X is 26 and Y is 42; X is 26 and Y is 43; X is 26 and Y is 44; X is 26 and y is 45; X is 26 and Y is 46; X is 26 and Y is 47; X is 26 and Y is 48; X is 26 and Y is 49; X is 26 and Y is 50; X is 26 and Y is 51; X is 26 and Y is 52; X is 26 and Y is 53; X is 26 and Y is 54; X is 26 and Y is 55; X is 26 and Y is 56; X is 26 and Y is 57; X is 26 and Y is 58; X is 26 and Y is 59; X is 26 and Y is 60; X is 26 and Y is 61; X is 26 and Y is 62; X is 26 and Y is 63; X is 26 and Y is 64; X is 26 and Y is 65; X is 26 and Y is 66; X is 26 and Y is 67; X is 26 and Y is 68; X is 26 and Y is 69; X is 26 and Y is 70; X is 26 and Y is 71; X is 26 and Y is 72; X is 26 and Y is 73; X is 26 and Y is 74; X is 26 and Y is 75; X is 26 and Y is 76; X is 26 and Y is 77; X is 26 and Y is 78; X is 26 and Y is 79; X is 26 and Y is 80; X is 26 and Y is 81; X is 26 and Y is 82; X is 26 and Y is 83; X is 26 and Y is 84; X is 26 and Y is 85; X is 26 and Y is 86; X is 26 and Y is 87; X is 26 and Y is 88; X is 26 and Y is 89; X is 26 and Y is 90; X is 26 and Y is 91; X is 26 and Y is 92; X is 26 and Y is 93; X is 26 and Y is 94; X is 26 and Y is 95; X is 26 and Y is 96; X is 26 and Y is 97; X is 26 and Y is 98; X is 26 and Y is 99; X is 26 and Y is 100; X is 26 and Y is 101; X is 26 and Y is 102; X is 26 and Y is 103; X is 26 Y is 104; X is 26 and Y is 105; X is 26 Y is 106; X is 26 and Y is 107; X is 26 and Y is 108; X is 26 and Y is 109; X is 26 and Y is 110; X is 26 and Y is 111; X is 26 and Y is 112; X is 26 and Y is 113; X is 26 and Y is 114; X is 26 and Y is 115; X is 26 and Y is 116; X is 26 and Y is 117; X is 26 and Y is 118; X is 26 and Y is 119; X is 26 and Y is 120; X is 26 and Y is 121; X is 26 and Y is 122; X is 26 and Y is 123; X is 26 and Y is 124; X is 26 and Y is 125; X is 26 and Y is 126; X is 26 and Y is 127; X is 26 and Y is 128; X is 26 and Y is 129; X is 26 and Y is 130; X is 26 and Y is 131; X is 26 and Y is 132; X is 26 and Y is 133; X is 26 and Y is 134; X is 26 and Y is 135; X is 26 and Y is 136; X is 26 and Y is 137; X is 26 and Y is 138; X is 26 and Y is 139; X is 26 and Y is 140; X is 26 and Y is 141; X is 26 and Y is 142; X is 26 and Y is 143; X is 26 and Y is 144; X is 26 and Y is 145; X is 26 and Y is 146; X is 26 and Y is 147; X is 26 and Y is 148; X is 26 and Y is 149; X is 26 and Y is 150; X is 26 and Y is 151; X is 26 and Y is 152; X is 26 and Y is 153; X is 26 and Y is 154; X is 26 and Y is 155; X is 26 and Y is 156; X is 26 and Y is 157; X is 26 and Y is 158; X is 26 and Y is 159; X is 26 and Y is 160; X is 26 and Y is 161; X is 26 and Y is 162; X is 26 and y is 163; X is 26 and Y is 164; X is 26 and Y is 165; X is 26 and Y is 166; X is 26 and Y is 167; X is 26 and Y is 168; X is 26 and Y is 169; X is 26 and Y is 170; X is 26 and Y is 171; X is 26 and Y is 172; X is 26 and Y is 173; X is 26 and Y is 174; X is 26 and Y is 175; X is 26 and Y is 176; X is 26 and Y is 177; X is 26 and Y is 178; X is 26 and Y is 179; X is 26 and Y is 180; X is 26 and Y is 181; X is 26 and Y is 187; X is 26 and Y is 183; X is 26 and Y is 184; X is 26 and Y is 185; X is 26 and Y is 186;
X is 27 and Y is 1; X is 27 and Y is 2; X is 27 and Y is 3; X is 27 and Y is 4; X is 27 and Y is 5; X is 27 and Y is 6; X is 27 and Y is 7; X is 27 and Y is 8; X is 27 and Y is 9; X is 27 and Y is 10; X is 27 and Y is 11; X is 27 and Y is 12; X is 27 and Y is 13; X is 27 and Y is 14; X is 27 and Y is 15; X is 27 and Y is 16; X is 27 and Y is 17; X is 27 and Y is 18; X is 27 and Y is 19; X is 27 and Y is 20; X is 27 and Y is 21; X is 27 and Y is 22; X is 27 and Y is 23; X is 27 and Y is 24; X is 27 and Y is 25; X is 27 and Y is 26; X is 27 and Y is 27; X is 27 and Y is 28; X is 27 and Y is 29; X is 27 and Y is 30; X is 27 and Y is 31; X is 27 and Y is 32; X is 27 and Y is 33; X is 27 and Y is 34; X is 27 and Y is 35; X is 27 and Y is 36; X is 27 and Y is 37; X is 27 and Y is 38; X is 27 and Y is 39; X is 27 and Y is 40; X is 27 and Y is 41; X is 27 and Y is 42; X is 27 and Y is 43; X is 27 and Y is 44; X is 27 and Y is 45; X is 27 and Y is 46; X is 27 and Y is 47; X is 27 and Y is 48; X is 27 and Y is 49; X is 27 and Y is 50; X is 27 and Y is 51; X is 27 and Y is 52; X is 27 and Y is 53; X is 27 and Y is 54; X is 27 and Y is 55; X is 27 and Y is 56; X is 27 and Y is 57; X is 27 and Y is 58; X is 27 and Y is 59; X is 27 and Y is 60; X is 27 and Y is 61; X is 27 and Y is 62; X is 27 and Y is 63; X is 27 and Y is 64; X is 27 and Y is 65; X is 27 and Y is 66; X is 27 and Y is 67; X is 27 and Y is 68; X is 27 and Y is 69; X is 27 and Y is 70; X is 27 and Y is 71; X is 27 and Y is 72; X is 27 and Y is 73; X is 27 and Y is 74; X is 27 and Y is 75; X is 27 and Y is 76; X is 27 and Y is 77; X is 27 and Y is 78; X is 27 and Y is 79; X is 27 and Y is 80; X is 27 and Y is 81; X is 27 and Y is 82; X is 27 and Y is 83; X is 27 and Y is 84; X is 27 and Y is 85; X is 27 and Y is 86; X is 27 and Y is 87; X is 27 and Y is 88; X is 27 and Y is 89; X is 27 and Y is 90; X is 27 and Y is 91; X is 27 and Y is 92; X is 27 and Y is 93; X is 27 and Y is 94; X is 27 and Y is 95; X is 27 and Y is 96; X is 27 and Y is 97; X is 27 and Y is 98; X is 27 and Y is 99; X is 27 and Y is 100; X is 27 and Y is 101; X is 27 and Y is 102; X is 27 and Y is 103; X is 27 and Y is 104; X is 27 and Y is 105; X is 27 and Y is 106; X is 27 and Y is 107; X is 27 and Y is 108; X is 27 and Y is 109; X is 27 and Y is 110; X is 27 and Y is 111; X is 27 and Y is 112; X is 27 and Y is 113; X is 27 and Y is 114; X is 27 and Y is 115; X is 27 and Y is 116; X is 27 and Y is 117; X is 27 and Y is 118; X is 27 and Y is 119; X is 27 and Y is 120; X is 27 and Y is 121; X is 27 and Y is 122; X is 27 and Y is 123; X is 27 and Y is 124; X is 27 and Y is 125; X is 27 and Y is 126; X is 27 and Y is 127; X is 27 and Y is 128; X is 27 and Y is 129; X is 27 and Y is 130; X is 27 and Y is 131; X is 27 and Y is 132; X is 27 and Y is 133; X is 27 and Y is 134; X is 27 and Y is 135; X is 27 and Y is 136; X is 27 and Y is 137; X is 27 and Y is 138; X is 27 and Y is 139; X is 27 and Y is 140; X is 27 and Y is 141; X is 27 and Y is 142; X is 27 and Y is 143; X is 27 and Y is 144; X is 27 and Y is 145; X is 27 and Y is 146; X is 27 and Y is 147; X is 27 and Y is 148; X is 27 and Y is 149; X is 27 and Y is 150; X is 27 and Y is 151; X is 27 and Y is 152; X is 27 and Y is 153; X is 27 and Y is 154; X is 27 and Y is 155; X is 27 and Y is 156; X is 27 and Y is 157; X is 27 and Y is 158; X is 27 and Y is 159; X is 27 and Y is 160; X is 27 and Y is 161; X is 27 and Y is 162; X is 27 and Y is 163; X is 27 and Y is 164; X is 27 and Y is 165; X is 27 and Y is 166; X is 27 and Y is 167; X is 27 and Y is 168; X is 27 and Y is 169; X is 27 and Y is 170; X is 27 and Y is 171; X is 27 and Y is 172; X is 27 and Y is 173; X is 27 and Y is 174; X is 27 and Y is 175; X is 27 and Y is 176; X is 27 and Y is 177; X is 27 and Y is 178; X is 27 and Y is 179; X is 27 and Y is 180; X is 27 and Y is 181; X is 27 and Y is 182; X is 27 and Y is 183; X is 27 and Y is 184; X is 27 and Y is 185; X is 27 and Y is 186; X is 28 and Y is 1; X is 28 and Y is 2; X is 28 and Y is 3; X is 28 and Y is 4; X is 28 and Y is 5; X is 28 and Y is 6; X is 28 and Y is 7; X is 28 and Y is 8; X is 28 and Y is 9; X is 28 and Y is 10; X is 28 and Y is 11; X is 28 and Y is 12; X is 28 and Y is 13; X is 28 and Y is 14; X is 28 and Y is 15; X is 28 and Y is 16; X is 28 and Y is 17; X is 28 and Y is 18; X is 28 and Y is 19; X is 28 and Y is 20; X is 28 and Y is 21; X is 28 and Y is 22; X is 28 and Y is 23; X is 28 and Y is 24; X is 28 and Y is 25; X is 28 and Y is 26; X is 28 and Y is 27; X is 28 and Y is 28; X is 28 and Y is 29; X is 28 and Y is 30; X is 28 and Y is 31; X is 28 and Y is 32; X is 28 and Y is 33; X is 28 and Y is 34; X is 28 and Y is 35; X is 28 and Y is 36; X is 28 and Y is 37; X is 28 and Y is 38; X is 28 and Y is 39; X is 28 and Y is 40; X is 28 and Y is 41; X is 28 and Y is 42; X is 28 and Y is 43; X is 28 and Y is 44; X is 28 and Y is 45; X is 28 and Y is 46; X is 28 and Y is 47; X is 28 and Y is 48; X is 28 and Y is 49; X is 28 and Y is 50; X is 28 and Y is 51; X is 28 and Y is 52; X is 28 and Y is 53; X is 28 and Y is 54; X is 28 and Y is 55; X is 28 and Y is 56; X is 28 and Y is 57; X is 28 and Y is 58; X is 28 and Y is 59; X is 28 and Y is 60; X is 28 and is 61; X is 28 and Y is 62; X is 28 and Y is 63; X is 28 and Y is 64; X is 28 and Y is 65; X is 28 and Y is 66; X is 28 and Y is 67; X is 28 and Y is 68; X is 28 and Y is 69; X is 28 and Y is 70; X is 28 and Y is 71; X is 28 and Y is 72; X is 28 and Y is 73; X is 28 and Y is 74; X is 28 and Y is 75; X is 28 and Y is 76; X is 28 and Y is 77; X is 28 and Y is 78; X is 28 and Y is 79; X is 28 and Y is 80; X is 28 and Y is 81; X is 28 and Y is 82; X is 28 and Y is 83; X is 28 and Y is 84; X is 28 and Y is 85; X is 28 and Y is 86; X is 28 and Y is 87; X is 28 and Y is 88; X is 28 and Y is 89; X is 28 and Y is 90; X is 28 and Y is 91; X is 28 and Y is 92; X is 28 and Y is 93; X is 28 and Y is 94; X is 28 and Y is 95; X is 28 and Y is 96; X is 28 and Y is 97; X is 28 and Y is 98; X is 28 and Y is 99; X is 28 and Y is 100; X is 28 and Y is 101; X is 28 and Y is 102; X is 28 and Y is 103; X is 28 and Y is 104; X is 28 and Y is 105; X is 28 and Y is 106; X is 28 and Y is 107; X is 28 and Y is 108; X is 28 and Y is 109; X is 28 and Y is 110; X is 28 and Y is 111; X is 28 and Y is 112; X is 28 and Y is 113; X is 28 and Y is 114; X is 28 and Y is 115; X is 28 and Y is 116; X is 28 and Y is 117; X is 28 and Y is 118; X is 28 and Y is 119; X is 28 and Y is 120; X is 28 and Y is 121; X is 28 and Y is 122; X is 28 and Y is 123; X is 28 and Y is 124; X is 28 and Y is 125; X is 28 and Y is 126; X is 28 and Y is 127; X is 28 and Y is 128; X is 28 and Y is 129; X is 28 and Y is 130; X is 28 and Y is 131; X is 28 and Y is 132; X is 28 and Y is 133; X is 28 and Y is 134; X is 28 and Y is 135; X is 28 and Y is 136; X is 28 and Y is 137; X is 28 and Y is 138; X is 28 and Y is 139; X is 28 and Y is 140; X is 28 and Y is 141; X is 28 and Y is 142; X is 28 and Y is 143; X is 28 and Y is 144; X is 28 and Y is 145; X is 28 and Y is 146; X is 28 and Y is 147; X is 28 and Y is 148; X is 28 and Y is 149; X is 28 and Y is 150; X is 28 and Y is 151; X is 28 and Y is 152; X is 28 and Y is 153; X is 28 and Y is 154; X is 28 and Y is 155; X is 28 and Y is 156; X is 28 and Y is 157; X is 28 and Y is 158; X is 28 and Y is 159; X is 28 and Y is 160; X is 28 and Y is 161; X is 28 and Y is 162; X is 28 and Y is 163; X is 28 and Y is 164; X is 28 and Y is 165; X is 28 and Y is 166; X is 28 and Y is 167; X is 28 and Y is 168; X is 28 and Y is 169; X is 28 and Y is 170; X is 28 and Y is 171; X is 28 and Y is 172; X is 28 and Y is 173; X is 28 and Y is 174; X is 28 and Y is 175; X is 28 and Y is 176; X is 28 and Y is 177; X is 28 and Y is 178; X is 28 and Y is 179; X is 28 and Y is 180; X is 28 and Y is 181; X is 28 and Y is 182; X is 28 and Y is 183; X is 28 and Y is 184; X is 28 and Y is 185; X is 28 and Y is 186;

X is 29 and Y is 1; X is 29 and Y is 2; X is 29 and Y is 3; X is 29 and Y is 4; X is 29 and Y is 5; X is 29 and Y is 6; X is 29 and Y is 7; X is 29 and Y is 8; X is 29 and Y is 9; X is 29 and Y is 10; X is 29 and Y is 11; X is 29 and Y is 12; X is 29 and Y is 13; X is 29 and Y is 14; X is 29 and Y is 15; X is 29 and Y is 16; X is 29 and Y is 17; X is 29 and Y is 18; X is 29 and Y is 19; X is 29 and Y is 20; X is 29 and Y is 21; X is 29 and Y is 22; X is 29 and Y is 23; X is 29 and Y is 24; X is 29 and Y is 25; X is 29 and Y is 26; X is 29 and Y is 27; X is 29 and Y is 28; X is 29 and Y is 29; X is 29 and Y is 30; X is 29 and Y is 31; X is 29 and Y is 32; X is 29 and Y is 33; X is 29 and Y is 34; X is 29 and Y is 35; X is 29 and Y is 36; X is 29 and Y is 37; X is 29 and Y is 38; X is 29 and Y is 39; X is 29 and Y is 40; X is 29 and Y is 41; X is 29 and Y is 42; X is 29 and Y is 43; X is 29 and Y is 44; X is 29 and Y is 45; X is 29 and Y is 46; X is 29 and Y is 47; X is 29 and Y is 48; X is 29 and Y is 49; X is 29 and Y is 50; X is 29 and Y is 51; X is 29 and Y is 52; X is 29 and Y is 53; X is 29 and Y is 54; X is 29 and Y is 55; X is 29 and Y is 56; X is 29 and Y is 57; X is 29 and Y is 58; X is 29 and Y is 59; X is 29 and Y is 60; X is 29 and Y is 61; X is 29 and Y is 62; X is 29 and Y is 63; X is 29 and Y is 64; X is 29 and Y is 65; X is 29 and Y is 66; X is 29 and Y is 67; X is 29 and Y is 68; X is 29 and Y is 69; X is 29 and Y is 70; X is 29 and Y is 71; X is 29 and Y is 72; X is 29 and Y is 73; X is 29 and Y is 74; X is 29 and Y is 75; X is 29 and Y is 76; X is 29 and Y is 77; X is 29 and Y is 78; X is 29 and Y is 79; X is 29 and Y is 80; X is 29 and Y is 81; X is 29 and Y is 82; X is 29 and Y is 83; X is 29 and Y is 84; X is 29 and Y is R5; X is 29 and Y is 86; X is 29 and Y is 87; X is 29 and Y is 88; X is 29 and Y is 89; X is 29 and Y is 90; X is 29 and Y is 91; X is 29 and Y is 92; X is 29 and Y is 93; X is 29 and Y is 94; X is 29 and Y is 95; X is 29 and Y is 96; X is 29 and Y is 97; X is 29 and Y is 98; X is 29 and Y is 99; X is 29 and Y is 100; X is 29 and Y is 101; X is 29 and Y is 102; X is 29 and Y is 103; X is 29 and Y is 104; X is 29 and Y is 105; X is 29 and Y is 106; X is 29 and Y is 107; X is 29 and Y is 108; X is 29 and Y is 109; X is 29 and Y is 110; X is 29 and Y is 111; X is 29 and Y is 112; X is 29 and Y is 113; X is 29 and Y is 114; X is 29 and Y is 115; X is 29 and Y is 116; X is 29 and Y is 117; X is 29 and Y is 118; X is 29 and Y is 119; X is 29 and Y is 120; X is 29 and Y is 121; X is 29 and Y is 122; X is 29 and Y is 123; X is 29 and Y is 124; X is 29 and Y is 125; X is 29 and Y is 126; X is 29 and Y is 127; X is 29 and Y is 128; X is 29 and Y is 129; X is 29 and Y is 130; X is 29 and Y is 131; X is 29 and Y is 132; X is 29 and Y is 133; X is 29 and Y is 134; X is 29 and Y is 135; X is 29 and Y is 136; X is 29 and Y is 137; X is 29 and Y is 138; X is 29 and Y is 139; X is 29 and Y is 140; X is 29 and Y is 141; X is 29 and Y is 142; X is 29 and Y is 143; X is 29 and Y is 144; X is 29 and Y is 145; X is 29 and Y is 146; X is 29 and Y is 147; X is 29 and Y is 148; X is 29 and Y is 149; X is 29 and Y is 150; X is 29 and Y is 151; X is 29 and Y is 152; X is 29 and Y is 153; X is 29 and Y is 154; X is 29 and Y is 155; X is 29 and Y is 156; X is 29 and Y is 157; X is 29 and Y is 158; X is 29 and Y is 159; X is 29 and Y is 160; X is 29 and Y is 161; X is 29 and Y is 162; X is 29 and Y is 163; X is 29 and Y is 164; X is 29 and Y is 165; X is 29 and Y is 166; X is 29 and y is 167; X is 29 and Y is 168; X is 29 and Y is 169; X is 29 and Y is 170; X is 29 and Y is 171; X is 29 and Y is 172; X is 29 and Y is 173; X is 29 and Y is 174; X is 29 and Y is 175; X is 29 and Y is 176; X is 29 and Y is 177; X is 29 and Y is 178; X is 29 and Y is 179; X is 29 and Y is 180; X is 29 and Y is 181; X is 29 and Y is 182; X is 29 and Y is 183; X is 29 and Y is 184; X is 29 and Y is 185; X is 29 and Y is 186;

X is 30 and Y is 1; X is 30 and Y is 2; X is 30 and Y is 3; X is 30 and Y is 4; X is 30 and Y is 5; X is 30 and Y is 6; X is 30 and Y is 7; X is 30 and Y is 8; X is 30 and Y is 9; X is 30 and Y is 10; X is 30 and Y is 11; X is 30 and Y is 12; X is 30 and Y is 13; X is 30 and Y is 14; X is 30 and Y is 15; X is 30 and Y is 16; X is 30 and Y is 17; X is 30 and Y is 18; X is 30 and Y is 19; X is 30 and Y is 20; X is 30 and Y is 21; X is 30 and Y is 22; X is 30 and Y is 23; X is 30 and Y is 24; X is 30 and Y is 25; X is 30 and Y is 26; X is 30 and Y is 27; X is 30 and Y is 28; X is 30 and Y is 29; X is 30 and Y is 30; X is 30 and Y is 31; X is 30 and Y is 32; X is 30 and Y is 33; X is 30 and Y is 34; X is 30 and Y is 35; X is 30 and Y is 36; X is 30 and Y is 37; X is 30 and Y is 38; X is 30 and Y is 39; X is 30 and Y is 40; X is 30 and Y is 41; X is 30 and Y is 42; X is 30 and Y is 43; X is 30 and Y is 44; X is 30 and Y is 45; X is 30 and Y is 46; X is 30 and Y is 47; X is 30 and Y is 48; X is 30 and Y is 49; X is 30 and Y is 50; X is 30 and Y is 51; X is 30 and Y is 52; X is 30 and Y is 53; X is 30 and Y is 54; X is 30 and Y is 55; X is 30 and Y is 56; X is 30 and Y is 57; X is 30 and Y is 58; X is 30 and Y is 59; X is 30 and Y is 60; X is 30 and Y is 61; X is 30 and Y is 62; X is 30 and Y is 63; X is 30 and Y is 64; X is 30 and Y is 65; X is 30 and Y is 66; X is 30 and Y is 67; X is 30 and Y is 68; X is 30 and Y is 69; X is 30 and Y is 70; X is 30 and Y is 71; X is 30 and Y is 72; X is 30 and Y is 73; X is 30 and Y is 74; X is 30 and Y is 75; X is 30 and Y is 76; X is 30 and Y is 77; X is 30 and Y is 78; X is 30 and Y is 79; X is 30 and Y is 80; X is 30 and Y is 81; X is 30 and Y is 82; X is 30 and Y is 83; X is 30 and Y is 84; X is 30 and Y is 85; X is 30 and Y is 86; X is 30 and Y is 87; X is 30 and Y is 88; X is 30 and Y is 89; X is 30 and Y is 90; X is 30 and Y is 91; X is 30 and Y is 92; X is 30 and Y is 93; X is 30 and Y is 94; X is 30 and Y is 95; X is 30 and Y is 96; X is 30 and is 97; X is 30 and Y is 98; X is 30 and Y is 99; X is 30 and Y is 100; X is 30 and Y is 101; X is 30 and Y is 102; X is 30 and Y is 103; X is 30 and Y is 104; X is 30 and Y is 105; X is 30 and Y is 106; X is 30 and Y is 107; X is 30 and Y is 108; X is 30 and Y is 109; X is 30 and Y is 110; X is 30 and Y is 111; X is 30 and Y is 112; X is 30 and Y is 113; X is 30 and Y is 114; X is 30 and Y is 115; X is 30 and Y is 116; X is 30 and Y is 117; X is 30 and Y is 118; X is 30 and Y is 119; X is 30 and Y is 120; X is 30 and Y is 121; X is 30 and Y is 122; X is 30 and Y is 123; X is 30 and Y is 124; X is 30 and Y is 125; X is 30 and Y is 126; X is 30 and Y is 127; X is 30 and Y is 128; X is 30 and Y is 129; X is 30 and Y is 130; X is 30 and Y is 131; X is 30 and Y is 132; X is 30 and Y is 133; X is 30 and Y is 134; X is 30 and Y is 135; X is 30 and Y is 136; X is 30 and Y is 137; X is 30 and Y is 138; X is 30 and Y is 139; X is 30 and Y is 140; X is 30 and Y is 141; X is 30 and Y is 142; X is 30 and Y is 143; X is 30 and Y is 144; X is 30 and Y is 145; X is 30 and Y is 146; X is 30 and Y is 147; X is 30 and Y is 148; X is 30 and Y is 149; X is 30 and Y is 150; X is 30 and Y is 151; X is 30 and Y is 152; X is 30 and Y is 153; X is 30 and Y is 154; X is 30 and Y is 155; X is 30 and Y is 156; X is 30 and Y is 157; X is 30 and Y is 158; X is 30 and Y is 159; X is 30 and Y is 160; X is 30 and Y is 161; X is 30 and Y is 162; X is 30 and Y is 163; X is 30 and Y is 164; X is 30 and Y is 165; X is 30 and Y is 166; X is 30 and Y is 167; X is 30 and Y is 168; X is 30 and Y is 169; X is 30 and Y is 170; X is 30 and Y is 171; X is 30 and Y is 172; X is 30 and Y is 173; X is 30 and Y is 174; X is 30 and Y is 175; X is 30 and Y is 176; X is 30 and Y is 177; X is 30 and Y is 178; X is 30 and Y is 179; X is 30 and Y is 180; X is 30 and Y is 181; X is 30 and Y is 182; X is 30 and Y is 183; X is 30 and Y is 184; X is 30 and Y is 185; X is 30 and Y is 186;

X is 31 and Y is 1; X is 31 and Y is 2; X is 31 and Y is 3; X is 31 and Y is 4; X is 31 and Y is 5; X is 31 and Y is 6; X is 31 and Y is 7; X is 31 and Y is 8; X is 31 and Y is 9; X is 31 and Y is 10; X is 31 and Y is 11; X is 31 and Y is 12; X is 31 and Y is 13; X is 31 and Y is 14; X is 31 and Y is 15; X is 31 and Y is 16; X is 31 and Y is 17; X is 31 and Y is 18; X is 31 and Y is 19; X is 31 and Y is 20; X is 31 and Y is 21; X is 31 and Y is 22; X is 31 and Y is 23; X is 31 and Y is 24; X is 31 and Y is 25; X is 31 and Y is 26; X is 31 and Y is 27; X is 31 and Y is 28; X is 31 and Y is 29; X is 31 and Y is 30; X is 31 and Y is 31; X is 31 and Y is 32; X is 31 and Y is 33; X is 31 and Y is 34; X is 31 and Y is 35; X is 31 and Y is 36; X is 31 and Y is 37; X is 31 and Y is 38; X is 31 and Y is 39; X is 31 and Y is 40; X is 31 and Y is 41; X is 31 and Y is 42; X is 31 and Y is 43; X is 31 and Y is 44; X is 31 and Y is 45; X is 31 and Y is 46; X is 31 and Y is 47; X is 31 and Y is 48; X is 31 and Y is 49; X is 31 and Y is 50; X is 31 and Y is 51; X is 31 and Y is 52; X is 31 and Y is 53; X is 31 and Y is 54; X is 31 and Y is 55; X is 31 and Y is 56; X is 31 and Y is 57; X is 31 and Y is 58; X is 31 and Y is 59; X is 31 and Y is 60; X is 31 and Y is 61; X is 31 and Y is 62; X is 31 and Y is 63; X is 31 and Y is 64; X is 31 and Y is 65; X is 31 and Y is 66; X is 31 and Y is 67; X is 31 and Y is 68; X is 31 and Y is 69; X is 31 and Y is 70; X is 31 and Y is 71; X is 31 and Y is 72; X is 31 and Y is 73; X is 31 and Y is 74; X is 31 and Y is 75; X is 31 and Y is 76; X is 31 and Y is 77; X is 31 and Y is 78; X is 31 and Y is 79; X is 31 and Y is 80; X is 31 and Y is 81; X is 31 and Y is 82; X is 31 and Y is 83; X is 31 and Y is 84; X is 31 and Y is 85; X is 31 and Y is 86; X is 31 and Y is 87; X is 31 and Y is 88; X is 31 and Y is 89; X is 31 and Y is 90; X is 31 and Y is 91; X is 31 and Y is 92; X is 31 and Y is 93; X is 31 and Y is 94; X is 31 and Y is 95; X is 31 and Y is 96; X is 31 and Y is 97; X is 31 and Y is 98; X is 31 and Y is 99; X is 31 and Y is 100; X is 31 and Y is 101; X is 31 and Y is 102; X is 31 and Y is 103; X is 31 and Y is 104; X is 31 and Y is 105; X is 31 and Y is 106; X is 31 and Y is 107; X is 31 and Y is 108; X is 31 and Y is 109; X is 31 and Y is 110; X is 31 and Y is 111; X is 31 and Y is 112; X is 31 and Y is 113; X is 31 and Y is 114; X is 31 and Y is 115; X is 31 and Y is 116; X is 31 and Y is 117; X is 31 and Y is 118; X is 31 and Y is 119; X is 31 and Y is 120; X is 31 and Y is 121; X is 31 and Y is 122; X is 31 and Y is 123; X is 31 and Y is 124; X is 31 and Y is 125; X is 31 and Y is 126; X is 31 and Y is 127; X is 31 and Y is 128; X is 31 and Y is 129; X is 31 and Y is 130; X is 31 and Y is 131; X is 31 and Y is 132; X is 31 and Y is 133; X is 31 and Y is 134; X is 31 and Y is 135; X is 31 and Y is 136; X is 31 and Y is 137; X is 31 and Y is 138; X is 31 and Y is 139; X is 31 and Y is 140; X is 31 and Y is 141; X is 31 and Y is 142; X is 31 and Y is 143; X is 31 and Y is 144; X is 31 and Y is 145; X is 31 and Y is 146; X is 31 and Y is 147; X is 31 and Y is 148; X is 31 and Y is 149; X is 31 and Y is 150; X is 31 and Y is 151; X is 31 and Y is 152; X is 31 and Y is 153; X is 31 and Y is 154; X is 31 and Y is 155; X is 31 and Y is 156; X is 31 and Y is 157; X is 31 and Y is 158; X is 31 and Y is 159; X is 31 and Y is 160; X is 31 and Y is 161; X is 31 and Y is 162; X is 31 and Y is 163; X is 31 and Y is 164; X is 31 and Y is 165; X is 31 and Y is 166; X is 31 and Y is 167; X is 31 and Y is 168; X is 31 and Y is 169; X is 31 and Y is 170; X is 31 and Y is 171; X is 31 and Y is 172; X is 31 and Y is 173; X is 31 and Y is 174; X is 31 and Y is 175; X is 31 and Y is 176; X is 31 and Y is 177; X is 31 and Y is 178; X is 31 and Y is 179; X is 31 and Y is 180; X is 31 and Y is 181; X is 31 and Y is 182; X is 31 and Y is 183; X is 31 and Y is 184; X is 31 and Y is 185; X is 31 and Y is 186; X is 32 and Y is 1; X is 32 and Y is 2; X is 32 and Y is 3; X is 32 and Y is 4; X is 32 and Y is 5; X is 32 and Y is 6; X is 32 and Y is 7; X is 32 and Y is 8; X is 32 and Y is 9; X is 32 and Y is 10; X is 32 and Y is 11; X is 32 and Y is 12; X is 32 and Y is 13; X is 32 and Y is 14; X is 32 and Y is 15; X is 32 and Y is 16; X is 32 and Y is 17; X is 32 and Y is 18; X is 32 and Y is 19; X is 32 and Y is 20; X is 32 and Y is 21; X is 32 and Y is 22; X is 32 and Y is 23; X is 32 and Y is 24; X is 32 and Y is 25; X is 32 and Y is 26; X is 32 and Y is 27; X is 32 and Y is 28; X is 32 and Y is 29; X is 32 and Y is 30; X is 32 and Y is 31; X is 32 and Y is 32; X is 32 and Y is 33; X is 32 and Y is 34; X is 32 and Y is 35; X is 32 and Y is 36; X is 32 and Y is 37; X is 32 and Y is 38; X is 32 and Y is 39; X is 32 and Y is 40; X is 32 and Y is 41; X is 32 and Y is 42; X is 32 and Y is 43; X is 32 and Y is 44; X is 32 and Y is 45; X is 32 and Y is 46; X is 32 and Y is 47; X is 32 and Y is 48; X is 32 and Y is 49; X is 32 and Y is 50; X is 32 and Y is 51; X is 32 and Y is 52; X is 32 and Y is 53; X is 32 and Y is 54; X is 32 and Y is 55; X is 32 and Y is 56; X is 32 and Y is 57; X is 32 and Y is 58; X is 32 and Y is 59; X is 32 and Y is 60; X is 32 and Y is 61; X is 32 and Y is 62; X is 32 and Y is 63; X is 32 and Y is 64; X is 32 and Y is 65; X is 32 and Y is 66; X is 32 and Y is 67; X is 32 and Y is 68; X is 32 and Y is 69; X is 32 and Y is 70; X is 32 and Y is 71; X is 32 and Y is 72; X is 32 and Y is 73; X is 32 and Y is 74; X is 32 and Y is 75; X is 32 and Y is 76; X is 32 and Y is 77; X is 32 and Y is 78; X is 32 and Y is 79; X is 32 and Y is 80; X is 32 and Y is 81; X is 32 and Y is 82; X is 32 and Y is 83; X is 32 and Y is 84; X is 32 and Y is 85; X is 32 and Y is 86; X is 32 and Y is 87; X is 32 and Y is 88; X is 32 and Y is 89; X is 32 and Y is 90; X is 32 and Y is 91; X is 32 and Y is 92; X is 32 and Y is 93; X is 32 and Y is 94; X is 32 and Y is 95; X is 32 and Y is 96; X is 32 and Y is 97; X is 32 and Y is 98; X is 32 and Y is 99; X is 32 and Y is 100; X is 32 and Y is 101; X is 32 and Y is 102; X is 32 and Y is 103; X is 32 and Y is 104; X is 32 and Y is 105; X is 32 and Y is 106; X is 32 and Y is 107; X is 32 and Y is 108; X is 32 and Y is 109; X is 32 and Y is 110; X is 32 and Y is 111; X is 32 and Y is 112; X is 32 and Y is 113; X is 32 and Y is 114; X is 32 and Y is 115; X is 32 and Y is 116; X is 32 and Y is 117; X is 32 and Y is 118; X is 32 and Y is 119; X is 32 and Y is 120; X is 32 and Y is 121; X is 32 and Y is 122; X is 32 and Y is 123; X is 32 and Y is 124; X is 32 and Y is 125; X is 32 and Y is 126; X is 32 and Y is 127; X is 32 and Y is 128; X is 32 and Y is 129; X is 32 and Y is 130; X is 32 and Y is 131; X is 32 and Y is 132; X is 32 and Y is 133; X is 32 and Y is 134; X is 32 and Y is 135; X is 32 and Y is 136; X is 32 and Y is 137; X is 32 and Y is 138; X is 32 and Y is 139; X is 32 and Y is 140; X is 32 and Y is 141; X is 32 and Y is 142; X is 32 and Y is 143; X is 32 and Y is 144; X is 32 and Y is 145; X is 32 and Y is 146; X is 32 and Y is 147; X is 32 and Y is 148; X is 32 and Y is 149; X is 32 and Y is 150; X is 32 and Y is 151; X is 32 and Y is 152; X is 32 and Y is 153; X is 32 and Y is 154; X is 32 and Y is 155; X is 32 and Y is 156; X is 32 and Y is 157; X is 32 and Y is 158; X is 32 and Y is 159; X is 32 and Y is 160; X is 32 and Y is 161; X is 32 and Y is 162; X is 32 and Y is 163; X is 32 and Y is 164; X is 32 and Y is 165; X is 32 and Y is 166; X is 32 and Y is 167; X is 32 and Y is 168; X is 32 and Y is 169; X is 32 and Y is 170; X is 32 and Y is 171; X is 32 and Y is 172; X is 32 and Y is 173; X is 32 and Y is 174; X is 32 and Y is 175; X is 32 and Y is 176; X is 32 and Y is 177; X is 32 and Y is 178; X is 32 and Y is 179; X is 32 and Y is 180; X is 32 and Y is 181; X is 32 and Y is 182; X is 32 and Y is 183; X is 32 and Y is 184; X is 32 and Y is 185; X is 32 and Y is 186; X is 33 and Y is 1; X is 33 and Y is 2; X is 33 and Y is 3; X is 33 and Y is 4; X is 33 and Y is 5; X is 33 and Y is 6; X is 33 and Y is 7; X is 33 and Y is 8; X is 33 and Y is 9; X is 33 and Y is 10; X is 33 and Y is 11; X is 33 and Y is 12; X is 33 and Y is 13; X is 33 and Y is 14; X is 33 and Y is 15; X is 33 and Y is 16; X is 33 and Y is 17; X is 33 and Y is 18; X is 33 and Y is 19; X is 33 and Y is 20; X is 33 and Y is 21; X is 33 and Y is 22; X is 33 and Y is 23; X is 33 and Y is 24; X is 33 and Y is 25; X is 33 and Y is 26; X is 33 and Y is 27; X is 33 and Y is 28; X is 33 and Y is 29; X is 33 and Y is 30; X is 33 and Y is 31; X is 33 and Y is 32; X is 33 and Y is 33; X is 33 and Y is 34; X is 33 and Y is 35; X is 33 and Y is 36; X is 33 and Y is 37; X is 33 and Y is 38; X is 33 and Y is 39; X is 33 and Y is 40; X is 33 and Y is 41; X is 33 and Y is 42; X is 33 and Y is 43; X is 33 and Y is 44; X is 33 and Y is 45; X is 33 and Y is 46; X is 33 and Y is 47; X is 33 and Y is 48; X is 33 and Y is 49; X is 33 and Y is 50; X is 33 and Y is 51; X is 33 and Y is 52; X is 33 and Y is 53; X is 33 and Y is 54; X is 33 and Y is 55; X is 33 and Y is 56; X is 33 and Y is 57; X is 33 and Y is 58; X is 33 and Y is 59; X is 33 and Y is 60; X is 33 and Y is 61; X is 33 and Y is 62; X is 33 and Y is 63; X is 33 and Y is 64; X is 33 and Y is 65; X is 33 and Y is 66; X is 33 and Y is 67; X is 33 and Y is 68; X is 33 and Y is 69; X is 33 and Y is 70; X is 33 and y is 71; X is 33 and Y is 72; X is 33 and Y is 73; X is 33 and Y is 74; X is 33 and Y is 75; X is 33 and Y is 76; X is 33 and Y is 77; X is 33 and Y is 78; X is 33 and Y is 79; X is 33 and Y is 80; X is 33 and Y is 81; X is 33 and Y is 82; X is 33 and Y is 83; X is 33 and Y is 84; X is 33 and Y is 85; X is 33 and Y is 86; X is 33 and Y is 87; X is 33 and Y is 88; X is 33 and Y is 89; X is 33 and Y is 90; X is 33 and Y is 91; X is 33 and Y is 92; X is 33 and Y is 93; X is 33 and Y is 94; X is 33 and Y is 95; X is 33 and Y is 96; X is 33 and Y is 97; X is 33 and Y is 98; X is 33 and Y is 99; X is 33 and Y is 100; X is 33 and Y is 101; X is 33 and Y is 102; X is 33 and Y is 103; X is 33 and Y is 104; X is 33 and Y is 105; X is 33 and Y is 106; X is 33 and Y is 107; X is 33 and Y is 108; X is 33 and Y is 109; X is 33 and Y is 110; X is 33 and Y is 111; X is 33 and Y is 112; X is 33 and Y is 113; X is 33 and Y is 114; X is 33 and Y is 115; X is 33 and Y is 116; X is 33 and Y is 117; X is 33 and Y is 118; X is 33 and Y is 119; X is 33 and Y is 120; X is 33 and Y is 121; X is 33 and Y is 122; X is 33 and Y is 123; X is 33 and Y is 124; X is 33 and Y is 125; X is 33 and Y is 126; X is 33 and Y is 127; X is 33 and Y is 128; X is 33 and Y is 129; X is 33 and Y is 130; X is 33 and Y is 131; X is 33 and Y is 132; X is 33 and Y is 133; X is 33 and Y is 134; X is 33 and Y is 135; X is 33 and Y is 136; X is 33 and Y is 137; X is 33 and Y is 138; X is 33 and Y is 139; X is 33 and Y is 140; X is 33 and Y is 141; X is 33 and Y is 142; X is 33 and Y is 143; X is 33 and Y is 144; X is 33 and Y is 145; X is 33 and Y is 146; X is 33 and Y is 147; X is 33 and Y is 148; X is 33 and Y is 149; X is 33 and Y is 150; X is 33 and Y is 151; X is 33 and Y is 152; X is 33 and Y is 153; X is 33 and Y is 154; X is 33 and Y is 155; X is 33 and Y is 156; X is 33 and Y is 157; X is 33 and Y is 158; X is 33 and Y is 159; X is 33 and Y is 160; X is 33 and Y is 161; X is 33 and Y is 162; X is 33 and Y is 163; X is 33 and Y is 164; X is 33 and Y is 165; X is 33 and Y is 166; X is 33 and Y is 167; X is 33 and Y is 168; X is 33 and Y is 169; X is 33 and Y is 170; X is 33 and Y is 171; X is 33 and Y is 172; X is 33 and Y is 173; X is 33 and Y is 174; X is 33 and Y is 175; X is 33 and Y is 176; X is 33 and Y is 177; X is 33 and Y is 178; X is 33 and Y is 179; X is 33 and Y is 180; X is 33 and Y is 181; X is 33 and Y is 182; X is 33 and Y is 183; X is 33 and Y is 184; X is 33 and Y is 185; X is 33 and Y is 186; X is 34 and Y is 1; X is 34 and Y is 2; X is 34 and Y is 3; X is 34 and Y is 4; X is 34 and Y is 5; X is 34 and Y is 6; X is 34 and Y is 7; X is 34 and Y is 8; X is 34 and Y is 9; X is 34 and Y is 10; X is 34 and Y is 11; X is 34 and Y is 12; X is 34 and Y is 13; X is 34 and Y is 14; X is 34 and Y is 15; X is 34 and Y is 16; X is 34 and Y is 17; X is 34 and Y is 18; X is 34 and Y is 19; X is 34 and Y is 20; X is 34 and Y is 21; X is 34 and Y is 22; X is 34 and Y is 23; X is 34 and Y is 24; X is 34 and Y is 25; X is 34 and Y is 26; X is 34 and Y is 27; X is 34 and Y is 28; X is 34 and Y is 29; X is 34 and Y is 30; X is 34 and Y is 31; X is 34 and Y is 32; X is 34 and Y is 33; X is 34 and Y is 34; X is 34 and Y is 35; X is 34 and Y is 36; X is 34 and Y is 37; X is 34 and Y is 38; X is 34 and Y is 39; X is 34 and Y is 40; X is 34 and Y is 41; X is 34 and Y is 42; X is 34 and Y is 43; X is 34 and Y is 44; X is 34 and Y is 45; X is 34 and Y is 46; X is 34 and Y is 47; X is 34 and Y is 48; X is 34 and Y is 49; X is 34 and Y is 50; X is 34 and Y is 51; X is 34 and Y is 52; X is 34 and Y is 53; X is 34 and Y is 54; X is 34 and Y is 55; X is 34 and Y is 56; X is 34 and Y is 57; X is 34 and Y is 58; X is 34 and Y is 59; X is 34 and Y is 60; X is 34 and Y is 61; X is 34 and Y is 62; X is 34 and Y is 63; X is 34 and Y is 64; X is 34 and Y is 65; X is 34 and Y is 66; X is 34 and Y is 67; X is 34 and Y is 68; X is 34 and Y is 69; X is 34 and Y is 70; X is 34 and Y is 71; X is 34 and Y is 72; X is 34 and Y is 73; X is 34 and Y is 74; X is 34 and Y is 75; X is 34 and Y is 76; X is 34 and Y is 77; X is 34 and Y is 78; X is 34 and Y is 79; X is 34 and Y is 80; X is 34 and Y is 81; X is 34 and Y is 82; X is 34 and Y is 83; X is 34 and Y is 84; X is 34 and Y is 85; X is 34 and Y is 86; X is 34 and Y is 87; X is 34 and Y is 88; X is 34 and Y is 89; X is 34 and Y is 90; X is 34 and Y is 91; X is 34 and Y is 92; X is 34 and Y is 93; X is 34 and Y is 94; X is 34 and Y is 95; X is 34 and Y is 96; X is 34 and Y is 97; X is 34 and Y is 98; X is 34 and Y is 99; X is 34 and Y is 100; X is 34 and Y is 101; X is 34 and Y is 102; X is 34 and Y is 103; X is 34 and Y is 104; X is 34 and Y is 105; X is 34 and Y is 106; X is 34 and Y is 107; X is 34 and Y is 108; X is 34 and Y is 109; X is 34 and Y is 110; X is 34 and Y is 111; X is 34 and Y is 112; X is 34 and Y is 113; X is 34 and Y is 114; X is 34 and Y is 115; X is 34 and Y is 116; X is 34 and Y is 117; X is 34 and Y is 118; X is 34 and Y is 119; X is 34 and Y is 120; X is 34 and Y is 121; X is 34 and Y is 122; X is 34 and Y is 123; X is 34 and Y is 124; X is 34 and Y is 125; X is 34 and Y is 126; X is 34 and Y is 127; X is 34 and Y is 128; X is 34 and Y is 129; X is 34 and Y is 130; X is 34 and Y is 131; X is 34 and Y is 132; X is 34 and Y is 133; X is 34 and Y is 134; X is 34 and Y is 135; X is 34 and Y is 136; X is 34 and Y is 137; X is 34 and Y is 138; X is 34 and Y is 139; X is 34 and Y is 140; X is 34 and Y is 141; X is 34 and Y is 142; X is 34 and Y is 143; X is 34 and Y is 144; X is 34 and Y is 145; X is 34 and Y is 146; X is 34 and Y is 147; X is 34 and Y is 148; X is 34 and Y is 149; X is 34 and Y is 150; X is 34 and Y is 151; X is 34 and Y is 152; X is 34 and Y is 153; X is 34 and Y is 154; X is 34 and Y is 155; X is 34 and Y is 156; X is 34 and Y is 157; X is 34 and Y is 158; X is 34 and Y is 159; X is 34 and Y is 160; X is 34 and Y is 161; X is 34 and Y is 162; X is 34 and Y is 163; X is 34 and Y is 164; X is 34 and Y is 165; X is 34 and Y is 166; X is 34 and Y is 167; X is 34 and Y is 168; X is 34 and Y is 169; X is 34 and Y is 170; X is 34 and Y is 171; X is 34 and Y is 172; X is 34 and Y is 173; X is 34 and Y is 174; X is 34 and Y is 175; X is 34 and Y is 176; X is 34 and Y is 177; X is 34 and Y is 178; X is 34 and Y is 179; X is 34 and Y is 180; X is 34 and Y is 181; X is 34 and Y is 182; X is 34 and Y is 183; X is 34 and Y is 184; X is 34 and Y is 185; X is 34 and Y is 186; X is 35 and Y is 1; X is 35 and Y is 2; X is 35 and Y is 3; X is 35 and Y is 4; X is 35 and Y is 5; X is 35 and Y is 6; X is 35 and Y is 7; X is 35 and Y is 8; X is 35 and Y is 9; X is 35 and Y is 10; X is 35 and Y is 11; X is 35 and Y is 12; X is 35 and Y is 13; X is 35 and Y is 14; X is 35 and Y is 15; X is 35 and Y is 16; X is 35 and Y is 17; X is 35 and Y is 18; X is 35 and Y is 19; X is 35 and Y is 20; X is 35 and Y is 21; X is 35 and Y is 22; X is 35 and Y is 23; X is 35 and Y is 24; X is 35 and Y is 25; X is 35 and Y is 26; X is 35 and Y is 27; X is 35 and Y is 28; X is 35 and Y is 29; X is 35 and Y is 30; X is 35 and Y is 31; X is 35 and Y is 32; X is 35 and Y is 33; X is 35 and Y is 34; X is 35 and Y is 35; X is 35 and Y is 36; X is 35 and Y is 37; X is 35 and Y is 38; X is 35 and Y is 39; X is 35 and Y is 40; X is 35 and Y is 41; X is 35 and Y is 42; X is 35 and Y is 43; X is 35 and Y is 44; X is 35 and Y is 45; X is 35 and Y is 46; X is 35 and Y is 47; X is 35 and Y is 48; X is 35 and Y is 49; X is 35 and Y is 50; X is 35 and Y is 51; X is 35 and Y is 52; X is 35 and Y is 53; X is 35 and Y is 54; X is 35 and Y is 55; X is 35 and Y is 56; X is 35 and Y is 57; X is 35 and Y is 58; X is 35 and Y is 59; X is 35 and Y is 60; X is 35 and Y is 61; X is 35 and Y is 62; X is 35 and Y is 63; X is 35 and Y is 64; X is 35 and Y is 65; X is 35 and Y is 66; X is 35 and Y is 67; X is 35 and Y is 68; X is 35 and Y is 69; X is 35 and Y is 70; X is 35 and Y is 71; X is 35 and Y is 72; X is 35 and Y is 73; X is 35 and Y is 74; X is 35 and Y is 75; X is 35 and Y is 76; X is 35 and Y is 77; X is 35 and y is 78; X is 35 and Y is 79; X is 35 and Y is 80; X is 35 and Y is 81; X is 35 and Y is 82; X is 35 and Y is 83; X is 35 and Y is 84; X is 35 and Y is 85; X is 35 and Y is 86; X is 35 and Y is 87; X is 35 and Y is 88; X is 35 and Y is 89; X is 35 and Y is 90; X is 35 and Y is 91; X is 35 and Y is 92; X is 35 and Y is 93; X is 35 and Y is 94; X is 35 and Y is 95; X is 35 and Y is 96; X is 35 and Y is 97; X is 35 and Y is 98; X is 35 and Y is 99; is 35 and Y is 100; X is 35 and Y is 101; X is 35 and Y is 102; X is 35 and Y is 103; X is 35 and Y is 104; X is 35 and Y is 105; X is 35 and Y is 106; X is 35 and Y is 107; X is 35 and Y is 108; X is 35 and Y is 109; X is 35 and Y is 110; X is 35 and Y is 111; X is 35 and Y is 112; X is 35 and Y is 113; X is 35 and Y is 114; X is 35 and Y is 115; X is 35 and Y is 116; X is 35 and Y is 117; X is 35 and Y is 118; X is 35 and Y is 119; X is 35 and Y is 120; X is 35 and Y is 121; X is 35 and Y is 122; X is 35 and Y is 123; X is 35 and Y is 124; X is 35 and Y is 125; X is 35 and Y is 126; X is 35 and Y is 127; X is 35 and Y is 128; X is 35 and Y is 129; X is 35 and Y is 130; X is 35 and Y is 131; X is 35 and Y is 132; X is 35 and Y is 133; X is 35 and Y is 134; X is 35 and Y is 135; X is 35 and Y is 136; X is 35 and Y is 137; X is 35 and Y is 138; X is 35 and Y is 139; X is 35 and Y is 140; X is 35 and Y is 141; X is 35 and Y is 142; X is 35 and Y is 143; X is 35 and Y is 144; X is 35 and Y is 145; X is 35 and Y is 146; X is 35 and Y is 147; X is 35 and Y is 148; X is 35 and Y is 149; X is 35 and Y is 150; X is 35 and Y is 151; X is 35 and Y is 152; X is 35 and Y is 153; X is 35 and Y is 154; X is 35 and Y is 155; X is 35 and Y is 156; X is 35 and Y is 157; X is 35 and Y is 158; X is 35 and Y is 159; X is 35 and Y is 160; X is 35 and Y is 161; X is 35 and Y is 162; X is 35 and Y is 163; X is 35 and Y is 164; X is 35 and Y is 165; X is 35 and Y is 166; X is 35 and Y is 167; X is 35 and Y is 168; X is 35 and Y is 169; X is 35 and Y is 170; X is 35 and Y is 171; X is 35 and Y is 172; X is 35 and Y is 173; X is 35 and Y is 174; X is 35 and Y is 175; X is 35 and Y is 176; X is 35 and Y is 177; X is 35 and Y is 178; X is 35 and Y is 179; X is 35 and Y is 180; X is 35 and Y is 181; X is 35 and Y is 182; X is 35 and Y is 183; X is 35 and Y is 184; X is 35 and Y is 185; X is 35 and Y is 186;

X is 36 and Y is 1; X is 36 and Y is 2; X is 36 and Y is 3; X is 36 and Y is 4; X is 36 and Y is 5; X is 36 and Y is 6; X is 36 and Y is 7; X is 36 and Y is 8; X is 36 and Y is 9; X is 36 and Y is 10; X is 36 and Y is 11; X is 36 and Y is 12; X is 36 and Y is 13; X is 36 and Y is 14; X is 36 and Y is 15; X is 36 and Y is 16; X is 36 and Y is 17; X is 36 and Y is 18; X is 36 and Y is 19; X is 36 and Y is 20; X is 36 and Y is 21; X is 36 and Y is 22; X is 36 and Y is 23; X is 36 and Y is 24; X is 36 and Y is 25; X is 36 and Y is 26; X is 36 and Y is 27; X is 36 and Y is 28; X is 36 and Y is 29; X is 36 and Y is 30; X is 36 and Y is 31; X is 36 and Y is 32; X is 36 and Y is 33; X is 36 and Y is 34; X is 36 and Y is 35; X is 36 and Y is 36; X is 36 and Y is 37; X is 36 and Y is 38; X is 36 and Y is 39; X is 36 and Y is 40; X is 36 and Y is 41; X is 36 and Y is 42; X is 36 and Y is 43; X is 36 and Y is 44; X is 36 and Y is 45; X is 36 and Y is 46; X is 36 and Y is 47; X is 36 and Y is 48; X is 36 and Y is 49; X is 36 and Y is 50; X is 36 and Y is 51; X is 36 and Y is 52; X is 36 and Y is 53; X is 36 and Y is 54; X is 36 and Y is 55; X is 36 and Y is 56; X is 36 and Y is 57; X is 36 and Y is 58; X is 36 and Y is 59; X is 36 and Y is 60; X is 36 and Y is 61; X is 36 and Y is 62; X is 36 and Y is 63; X is 36 and Y is 64; X is 36 and Y is 65; X is 36 and Y is 66; X is 36 and Y is 67; X is 36 and Y is 68; X is 36 and Y is 69; X is 36 and Y is 70; X is 36 and Y is 71; X is 36 and Y is 72; X is 36 and Y is 73; X is 36 and Y is 74; X is 36 and Y is 75; X is 36 and Y is 76; X is 36 and Y is 77; X is 36 and Y is 78; X is 36 and Y is 79; X is 36 and Y is 80; X is 36 and Y is 81; X is 36 and Y is 82; X is 36 and Y is 83; X is 36 and Y is 84; X is 36 and Y is 85; X is 36 and Y is 86; X is 36 and Y is 87; X is 36 and Y is 88; X is 36 and Y is 89; X is 36 and Y is 90; X is 36 and Y is 91; X is 36 and Y is 92; X is 36 and Y is 93; X is 36 and Y is 94; X is 36 and Y is 95; X is 36 and Y is 96; X is 36 and Y is 97; X is 36 and Y is 98; X is 36 and Y is 99; X is 36 and Y is 100; X is 36 and Y is 101; X is 36 and Y is 102; X is 36 and Y is 103; X is 36 and Y is 104; X is 36 and Y is 105; X is 36 and Y is 106; X is 36 and Y is 107; X is 36 and Y is 108; X is 36 and Y is 109; X is 36 and Y is 110; X is 36 and Y is 111; X is 36 and Y is 112; X is 36 and Y is 113; X is 36 and Y is 114; X is 36 and Y is 115; X is 36 and Y is 116; X is 36 and Y is 117; X is 36 and Y is 118; X is 36 and Y is 119; X is 36 and Y is 120; X is 36 and Y is 121; X is 36 and Y is 122; X is 36 and Y is 123; X is 36 and Y is 124; X is 36 and Y is 125; X is 36 and Y is 126; X is 36 and Y is 127; X is 36 and Y is 128; X is 36 and Y is 129; X is 36 and Y is 130; X is 36 and Y is 131; X is 36 and Y is 132; X is 36 and Y is 133; X is 36 and Y is 134; X is 36 and Y is 135; X is 36 and Y is 136; X is 36 and Y is 137; X is 36 and Y is 138; X is 36 and Y is 139; X is 36 and Y is 140; X is 36 and Y is 141; X is 36 and Y is 142; X is 36 and Y is 143; X is 36 and Y is 144; X is 36 and Y is 145; X is 36 and Y is 146; X is 36 and Y is 147; X is 36 and Y is 148; X is 36 and Y is 149; X is 36 and Y is 150; X is 36 and Y is 151; X is 36 and Y is 152; X is 36 and Y is 153; X is 36 and Y is 154; X is 36 and Y is 155; X is 36 and Y is 156; X is 36 and Y is 157; X is 36 and Y is 158; X is 36 and Y is 159; X is 36 and is 160; X is 36 and Y is 161; X is 36 and Y is 162; X is 36 and Y is 163; X is 36 and Y is 164; X is 36 and Y is 165; X is 36 and Y is 166; X is 36 and Y is 167; X is 36 and Y is 168; X is 36 and Y is 169; X is 36 and Y is 170; X is 36 and Y is 171; X is 36 and Y is 172; X is 36 and Y is 173; X is 36 and Y is 174; X is 36 and Y is 175; X is 36 and Y is 176; X is 36 and Y is 177; X is 36 and Y is 178; X is 36 and Y is 179; X is 36 and Y is 180; X is 36 and Y is 181; X is 36 and Y is 182; X is 36 and Y is 183; X is 36 and Y is 184; X is 36 and Y is 185; X is 36 and Y is 186;

X is 37 and Y is 1; X is 37 and Y is 2; X is 37 and Y is 3; X is 37 and Y is 4; X is 37 and Y is 5; X is 37 and Y is 6; X is 37 and Y is 7; X is 37 and Y is 8; X is 37 and Y is 9; X is 37 and Y is 10; X is 37 and Y is 11; X is 37 and Y is 12; X is 37 and Y is 13; X is 37 and Y is 14; X is 37 and Y is 15; X is 37 and Y is 16; X is 37 and Y is 17; X is 37 and Y is 18; X is 37 and Y is 19; X is 37 and Y is 20; X is 37 and Y is 21; X is 37 and Y is 22; X is 37 and Y is 23; X is 37 and Y is 24; X is 37 and Y is 25; X is 37 and Y is 26; X is 37 and Y is 27; X is 37 and Y is 28; X is 37 and Y is 29; X is 37 and Y is 30; X is 37 and Y is 31; X is 37 and Y is 32; X is 37 and Y is 33; X is 37 and Y is 34; X is 37 and Y is 35; X is 37 and Y is 36; X is 37 and Y is 37; X is 37 and Y is 38; X is 37 and Y is 39; X is 37 and Y is 40; X is 37 and Y is 41; X is 37 and Y is 42; X is 37 and Y is 43; X is 37 and Y is 44; X is 37 and Y is 45; X is 37 and Y is 46; X is 37 and Y is 47; X is 37 and Y is 48; X is 37 and Y is 49; X is 37 and Y is 50; X is 37 and Y is 51; X is 37 and Y is 52; X is 37 and Y is 53; X is 37 and Y is 54; X is 37 and Y is 55; X is 37 and Y is 56; X is 37 and Y is 57; X is 37 and Y is 58; X is 37 and Y is 59; X is 37 and Y is 60; X is 37 and Y is 61; X is 37 and Y is 62; X is 37 and Y is 63; X is 37 and Y is 64; X is 37 and Y is 65; X is 37 and Y is 66; X is 37 and Y is 67; X is 37 and Y is 68; X is 37 and Y is 69; X is 37 and Y is 70; X is 37 and Y is 71; X is 37 and Y is 72; X is 37 and Y is 73; X is 37 and Y is 74; X is 37 and Y is 75; X is 37 and Y is 76; X is 37 and Y is 77; X is 37 and Y is 78; X is 37 and Y is 79; X is 37 and Y is 80; X is 37 and Y is 81; X is 37 and Y is 82; X is 37 and Y is 83; X is 37 and Y is 84; X is 37 and Y is 85; X is 37 and Y is 86; X is 37 and Y is 87; X is 37 and Y is 88; X is 37 and Y is 89; X is 37 and Y is 90; X is 37 and Y is 91; X is 37 and Y is 92; X is 37 and Y is 93; X is 37 and Y is 94; X is 37 and Y is 95; X is 37 and Y is 96; X is 37 and Y is 97; X is 37 and Y is 98; X is 37 and Y is 99; X is 37 and Y is 100; X is 37 and Y is 101; X is 37 and Y is 102; X is 37 and Y is 103; X is 37 and Y is 104; X is 37 and Y is 105; X is 37 and Y is 106; X is 37 and Y is 107; X is 37 and Y is 108; X is 37 and Y is 109; X is 37 and Y is 110; X is 37 and Y is 111; X is 37 and Y is 112; X is 37 and Y is 113; X is 37 and Y is 114; X is 37 and Y is 115; X is 37 and Y is 116; X is 37 and Y is 117; X is 37 and Y is 118; X is 37 and Y is 119; X is 37 and Y is 120; X is 37 and Y is 121; X is 37 and Y is 122; X is 37 and Y is 123; X is 37 and Y is 124; X is 37 and Y is 125; X is 37 and Y is 126; X is 37 and Y is 127; X is 37 and Y is 128; X is 37 and Y is 129; X is 37 and Y is 130; X is 37 and Y is 131; X is 37 and Y is 132; X is 37 and Y is 133; X is 37 and Y is 134; X is 37 and Y is 135; X is 37 and Y is 136; X is 37 and Y is 137; X is 37 and Y is 138; X is 37 and Y is 139; X is 37 and Y is 140; X is 37 and Y is 141; X is 37 and Y is 142; X is 37 and Y is 143; X is 37 and Y is 144; X is 37 and Y is 145; X is 37 and Y is 146; X is 37 and Y is 147; X is 37 and Y is 148; X is 37 and Y is 149; X is 37 and Y is 150; X is 37 and Y is 151; X is 37 and Y is 152; X is 37 and Y is 153; X is 37 and Y is 154; X is 37 and Y is 155; X is 37 and Y is 156; X is 37 and Y is 157; X is 37 and Y is 158; X is 37 and Y is 159; X is 37 and Y is 160; X is 37 and Y is 161; X is 37 and Y is 162; X is 37 and Y is 163; X is 37 and Y is 164; X is 37 and Y is 165; X is 37 and Y is 166; X is 37 and Y is 167; X is 37 and Y is 168; X is 37 and Y is 169; X is 37 and Y is 170; X is 37 and Y is 171; X is 37 and Y is 172; X is 37 and Y is 173; X is 37 and Y is 174; X is 37 and Y is 175; X is 37 and Y is 176; X is 37 and Y is 177; X is 37 and Y is 178; X is 37 and Y is 179; X is 37 and Y is 180; X is 37 and Y is 181; X is 37 and Y is 182; X is 37 and Y is 183; X is 37 and Y is 184; X is 37 and Y is 185; X is 37 and Y is 186; X is 38 and Y is 1; X is 38 and Y is 2; X is 38 and Y is 3; X is 38 and Y is 4; X is 38 and Y is 5; X is 38 and Y is 6; X is 38 and Y is 7; X is 38 and Y is 8; X is 38 and Y is 9; X is 38 and Y is 10; X is 38 and Y is 11; X is 38 and Y is 12; X is 38 and Y is 13; X is 38 and Y is 14; X is 38 and Y is 15; X is 38 and Y is 16; X is 38 and Y is 17; X is 38 and Y is 18; X is 38 and Y is 19; X is 38 and Y is 20; X is 38 and Y is 21; X is 38 and Y is 22; X is 38 and Y is 23; X is 38 and Y is 24; X is 38 and Y is 25; X is 38 and Y is 26; X is 38 and Y is 27; X is 38 and Y is 28; X is 38 and Y is 29; X is 38 and Y is 30; X is 38 and Y is 31; X is 38 and Y is 32; X is 38 and Y is 33; X is 38 and Y is 34; X is 38 and Y is 35; X is 38 and Y is 36; X is 38 and Y is 37; X is 38 and Y is 38; X is 38 and Y is 39; X is 38 and Y is 40; X is 38 and Y is 41; X is 38 and Y is 42; X is 38 and Y is 43; X is 38 and Y is 44; X is 38 and Y is 45; X is 38 and Y is 46; X is 38 and Y is 47; X is 38 and Y is 48; X is 38 and Y is 49; X is 38 and Y is 50; X is 38 and Y is 51; X is 38 and Y is 52; X is 38 and Y is 53; X is 38 and Y is 54; X is 38 and Y is 55; X is 38 and Y is 56; X is 38 and Y is 57; X is 38 and Y is 58; X is 38 and Y is 59; X is 38 and Y is 60; X is 38 and Y is 61; X is 38 and Y is 62; X is 38 and Y is 63; X is 38 and Y is 64; X is 38 and Y is 65; X is 38 and Y is 66; X is 38 and Y is 67; X is 38 and Y is 68; X is 38 and Y is 69; X is 38 and Y is 70; X is 38 and Y is 71; X is 38 and Y is 72; X is 38 and Y is 73; X is 38 and Y is 74; X is 38 and Y is 75; X is 38 and Y is 76; X is 38 and Y is 77; X is 38 and Y is 78; X is 38 and Y is 79; X is 38 and Y is 80; X is 38 and Y is 81; X is 38 and Y is 87; X is 38 and Y is 83; X is 38 and Y is 84; X is 38 and Y is 85; X is 38 and Y is 86; X is 38 and Y is 87; X is 38 and Y is 88; X is 38 and Y is 89; X is 38 and Y is 90; X is 38 and Y is 91; X is 38 and Y is 92; X is 38 and Y is 93; X is 38 and Y is 94; X is 38 and Y is 95; X is 38 and Y is 96; X is 38 and Y is 97; X is 38 and Y is 98; X is 38 and Y is 99; X is 38 and Y is 100; X is 38 and Y is 101; X is 38 and Y is 102; X is 38 and Y is 103; X is 38 and Y is 104; X is 38 and Y is 105; X is 38 and Y is 106; X is 38 and Y is 107; X is 38 and Y is 108; X is 38 and Y is 109; X is 38 and Y is 110; X is 38 and Y is 111; X is 38 and Y is 112; X is 38 and Y is 113; X is 38 and Y is 114; X is 38 and Y is 115; X is 38 and Y is 116; X is 38 and Y is 117; X is 38 and Y is 118; X is 38 and Y is 119; X is 38 and Y is 120; X is 38 and Y is 121; X is 38 and Y is 122; X is 38 and Y is 123; X is 38 and Y is 124; X is 38 and Y is 125; X is 38 and Y is 126; X is 38 and Y is 127; X is 38 and Y is 128; X is 38 and Y is 129; X is 38 and Y is 130; X is 38 and Y is 131; X is 38 and Y is 132; X is 38 and Y is 133; X is 38 and Y is 134; X is 38 and Y is 135; X is 38 and Y is 136; X is 38 and Y is 137; X is 38 and Y is 138; X is 38 and Y is 139; X is 38 and Y is 140; X is 38 and Y is 141; X is 38 and Y is 142; X is 38 and Y is 143; X is 38 and Y is 144; X is 38 and Y is 145; X is 38 and Y is 146; X is 38 and Y is 147; X is 38 and Y is 148; X is 38 and Y is 149; X is 38 and Y is 150; X is 38 and Y is 151; X is 38 and Y is 152; X is 38 and Y is 153; X is 38 and Y is 154; X is 38 and Y is 155; X is 38 and Y is 156; X is 38 and Y is 157; X is 38 and Y is 158; X is 38 and Y is 159; X is 38 and Y is 160; X is 38 and Y is 161; X is 38 and Y is 162; X is 38 and Y is 163; X is 38 and Y is 164; X is 38 and Y is 165; X is 38 and Y is 166; X is 38 and Y is 167; X is 38 and Y is 168; X is 38 and Y is 169; X is 38 and Y is 170; X is 38 and Y is 171; X is 38 and Y is 172; X is 38 and Y is 173; X is 38 and Y is 174; X is 38 and Y is 175; X is 38 and Y is 176; X is 38 and Y is 177; X is 38 and Y is 178; X is 38 and Y is 179; X is 38 and Y is 180; X is 38 and Y is 181; X is 38 and Y is 182; X is 38 and Y is 183; X is 38 and Y is 184; X is 38 and Y is 185; X is 38 and Y is 186; X is 39 and Y is 1; X is 39 and Y is 2; X is 39 and Y is 3; X is 39 and Y is 4; X is 39 and Y is 5; X is 39 and Y is 6; X is 39 and Y is 7; X is 39 and Y is 8; X is 39 and Y is 9; X is 39 and Y is 10; X is 39 and Y is 11; X is 39 and Y is 12; X is 39 and Y is 13; X is 39 and Y is 14; X is 39 and Y is 15; X is 39 and Y is 16; X is 39 and Y is 17; X is 39 and Y is 18; X is 39 and Y is 19; X is 39 and Y is 20; X is 39 and Y is 21; X is 39 and Y is 22; X is 39 and Y is 23; X is 39 and Y is 24; X is 39 and Y is 25; X is 39 and Y is 26; X is 39 and Y is 27; X is 39 and Y is 28; X is 39 and Y is 29; X is 39 and Y is 30; X is 39 and Y is 31; X is 39 and Y is 32; X is 39 and Y is 33; X is 39 and Y is 34; X is 39 and Y is 35; X is 39 and Y is 36; X is 39 and Y is 37; X is 39 and Y is 38; X is 39 and Y is 39; X is 39 and Y is 40; X is 39 and Y is 41; X is 39 and Y is 42; X is 39 and Y is 43; X is 39 and Y is 44; X is 39 and Y is 45; X is 39 and Y is 46; X is 39 and Y is 47; X is 39 and Y is 48; X is 39 and Y is 49; X is 39 and Y is 50; X is 39 and Y is 51; X is 39 and Y is 52; X is 39 and Y is 53; X is 39 and Y is 54; X is 39 and Y is 55; X is 39 and Y is 56; X is 39 and Y is 57; X is 39 and Y is 58; X is 39 and Y is 59; X is 39 and Y is 60; X is 39 and Y is 61; X is 39 and Y is 62; X is 39 and Y is 63; X is 39 and Y is 64; X is 39 and Y is 65; X is 39 and Y is 66; X is 39 and Y is 67; X is 39 and Y is 68; X is 39 and Y is 69; X is 39 and Y is 70; X is 39 and Y is 71; X is 39 and Y is 72; X is 39 and Y is 73; X is 39 and Y is 74; X is 39 and Y is 75; X is 39 and Y is 76; X is 39 and Y is 77; X is 39 and Y is 78; X is 39 and Y is 79; X is 39 and Y is 80; X is 39 and Y is 81; X is 39 and Y is 82; X is 39 and Y is 83; X is 39 and Y is 84; X is 39 and Y is 85; X is 39 and Y is 86; X is 39 and Y is 87; X is 39 and Y is 88; X is 39 and Y is 89; X is 39 and Y is 90; X is 39 and Y is 91; X is 39 and Y is 92; X is 39 and Y is 93; X is 39 and Y is 94; X is 39 and Y is 95; X is 39 and Y is 96; X is 39 and Y is 97; X is 39 and Y is 98; X is 39 and Y is 99; X is 39 and Y is 100; X is 39 and Y is 101; X is 39 and Y is 102; X is 39 and Y is 103; X is 39 and Y is 104; X is 39 and Y is 105; X is 39 and Y is 106; X is 39 and Y is 107; X is 39 and Y is 108; X is 39 and Y is 109; X is 39 and Y is 110; X is 39 and Y is 111; X is 39 and Y is 112; X is 39 and Y is 113; X is 39 and Y is 114; X is 39 and Y is 115; X is 39 and Y is 116; X is 39 and Y is 117; X is 39 and Y is 118; X is 39 and Y is 119; X is 39 and Y is 120; X is 39 and Y is 121; X is 39 and Y is 122; X is 39 and Y is 123; X is 39 and Y is 124; X is 39 and Y is 125; X is 39 and Y is 126; X is 39 and Y is 127; X is 39 and Y is 128; X is 39 and Y is 129; X is 39 and Y is 130; X is 39 and Y is 131; X is 39 and Y is 132; X is 39 and Y is 133; X is 39 and Y is 134; X is 39 and Y is 135; X is 39 and Y is 136; X is 39 and Y is 137; X is 39 and Y is 138; X is 39 and Y is 139; X is 39 and Y is 140; X is 39 and Y is 141; X is 39 and Y is 142; X is 39 and Y is 143; X is 39 awl Y is 144; X is 19 Y is 145; X is 39 and Y is 146; X is 39 and Y is 147; X is 39 and Y is 148; X is 39 and Y is 149; X is 39 and Y is 150; X is 39 and Y is 151; X is 39 and Y is 152; X is 39 and Y is 153; X is 39 and Y is 154; X is 39 and Y is 155; X is 39 and Y is 156; X is 39 and Y is 157; X is 39 and Y is 158; X is 39 and Y is 159; X is 39 and Y is 160; X is 39 and Y is 161; X is 39 and Y is 162; X is 39 and Y is 163; X is 39 and Y is 164; X is 39 and Y is 165; X is 39 and Y is 166; X is 39 and Y is 167; X is 39 and Y is 168; X is 39 and Y is 169; X is 39 and Y is 170; X is 39 and Y is 171; X is 39 and Y is 172; X is 39 and Y is 173; X is 39 and Y is 174; X is 39 and Y is 175; X is 39 and Y is 176; X is 39 and Y is 177; X is 39 and Y is 178; X is 39 and Y is 179; X is 39 and Y is 180; X is 39 and Y is 181; X is 39 and Y is 182; X is 39 and Y is 183; X is 39 and Y is 184; X is 39 and Y is 185; X is 39 and Y is 186;

X is 40 and Y is 1; X is 40 and Y is 2; X is 40 and Y is 3; X is 40 and Y is 4; X is 40 and Y is 5; X is 40 and Y is 6; X is 40 and Y is 7; X is 40 and Y is 8; X is 40 and Y is 9; X is 40 and Y is 10; X is 40 and Y is 11; X is 40 and Y is 12; X is 40 and Y is 13; X is 40 and Y is 14; X is 40 and Y is 15; X is 40 and Y is 16; X is 40 and Y is 17; X is 40 and Y is 18; X is 40 and Y is 19; X is 40 and Y is 20; X is 40 and Y is 21; X is 40 and Y is 22; X is 40 and Y is 23; X is 40 and Y is 24; X is 40 and Y is 25; X is 40 and Y is 26; X is 40 and Y is 27; X is 40 and Y is 28; X is 40 and Y is 29; X is 40 and Y is 30; X is 40 and Y is 31; X is 40 and Y is 32; X is 40 and Y is 33; X is 40 and Y is 34; X is 40 and Y is 35; X is 40 and Y is 36; X is 40 and Y is 37; X is 40 and Y is 38; X is 40 and Y is 39; X is 40 and Y is 40; X is 40 and Y is 41; X is 40 and Y is 42; X is 40 and Y is 43; X is 40 and Y is 44; X is 40 and Y is 45; X is 40 and Y is 46; X is 40 and Y is 47; X is 40 and Y is 48; X is 40 and Y is 49; X is 40 and Y is 50; X is 40 and Y is 51; X is 40 and Y is 52; X is 40 and Y is 53; X is 40 and Y is 54; X is 40 and Y is 55; X is 40 and Y is 56; X is 40 and Y is 57; X is 40 and Y is 58; X is 40 and Y is 59; X is 40 and Y is 60; X is 40 and Y is 61; X is 40 and Y is 62; X is 40 and Y is 63; X is 40 and Y is 64; X is 40 and Y is 65; X is 40 and Y is 66; X is 40 and Y is 67; X is 40 and Y is 68; X is 40 and Y is 69; X is 40 and Y is 70; X is 40 and Y is 71; X is 40 and Y is 72; X is 40 and Y is 73; X is 40 and Y is 74; X is 40 and Y is 75; X is 40 and Y is 76; X is 40 and Y is 77; X is 40 and Y is 78; X is 40 and Y is 79; X is 40 and Y is 80; X is 40 and Y is 81; X is 40 and Y is 82; X is 40 and Y is 83; X is 40 and Y is 84; X is 40 and Y is 85; X is 40 and Y is 86; X is 40 and Y is 87; X is 40 and Y is 88; X is 40 and Y is 89; X is 40 and Y is 90; X is 40 and Y is 91; X is 40 and Y is 92; X is 40 and Y is 93; X is 40 and Y is 94; X is 40 and Y is 95; X is 40 and Y is 96; X is 40 and Y is 97; X is 40 and Y is 98; X is 40 and Y is 99; X is 40 and Y is 100; X is 40 and Y is 101; X is 40 and Y is 102; X is 40 and Y is 103; X is 40 and Y is 104; X is 40 and Y is 105; X is 40 and Y is 106; X is 40 and Y is 107; X is 40 and Y is 108; X is 40 and Y is 109; X is 40 and Y is 110; X is 40 and Y is 111; X is 40 and Y is 112; X is 40 and Y is 113; X is 40 and Y is 114; X is 40 and Y is 115; X is 40 and Y is 116; X is 40 and Y is 117; X is 40 and Y is 118; X is 40 and Y is 119; X is 40 and Y is 120; X is 40 and Y is 121; X is 40 and Y is 122; X is 40 and Y is 123; X is 40 and Y is 124; X is 40 and Y is 125; X is 40 and Y is 126; X is 40 and Y is 127; X is 40 and Y is 128; X is 40 and Y is 129; X is 40 and Y is 130; X is 40 and Y is 131; X is 40 and Y is 132; X is 40 and Y is 133; X is 40 and Y is 134; X is 40 and Y is 135; X is 40 and Y is 136; X is 40 and Y is 137; X is 40 and Y is 138; X is 40 and Y is 139; X is 40 and Y is 140; X is 40 and Y is 141; X is 40 and Y is 142; X is 40 and Y is 143; X is 40 and Y is 144; X is 40 and Y is 145; X is 40 and Y is 146; X is 40 and Y is 147; X is 40 and Y is 148; X is 40 and Y is 149; X is 40 and Y is 150; X is 40 and Y is 151; X is 40 and Y is 152; X is 40 and Y is 153; X is 40 and Y is 154; X is 40 and Y is 155; X is 40 and Y is 156; X is 40 and Y is 157; X is 40 and Y is 158; X is 40 and Y is 159; X is 40 and Y is 160; X is 40 and Y is 161; X is 40 and Y is 162; X is 40 and Y is 163; X is 40 and Y is 164; X is 40 and Y is 165; X is 40 and Y is 166; X is 40 and Y is 167; X is 40 and Y is 168; X is 40 and Y is 169; X is 40 and Y is 170; X is 40 and Y is 171; X is 40 and Y is 172; X is 40 and Y is 173; X is 40 and Y is 174; X is 40 and Y is 175; X is 40 and Y is 176; X is 40 and Y is 177; X is 40 and Y is 178; X is 40 and Y is 179; X is 40 and Y is 180; X is 40 and Y is 181; X is 40 and Y is 182; X is 40 and Y is 183; X is 40 and Y is 184; X is 40 and Y is 185; X is 40 and Y is 186;

X is 41 and Y is 1; X is 41 and Y is 2; X is 41 and Y is 3; X is 41 and Y is 4; X is 41 and Y is 5; X is 41 and Y is 6; X is 41 and Y is 7; X is 41 and Y is 8; X is 41 and Y is 9; X is 41 and Y is 10; X is 41 and Y is 11; X is 41 and Y is 12; X is 41 and Y is 13; X is 41 and Y is 14; X is 41 and Y is 15; X is 41 and Y is 16; X is 41 and Y is 17; X is 41 and Y is 18; X is 41 and Y is 19; X is 41 and Y is 20; X is 41 and Y is 21; X is 41 and Y is 22; X is 41 and Y is 23; X is 41 and Y is 24; X is 41 and Y is 25; X is 41 and Y is 26; X is 41 and Y is 27; X is 41 and Y is 28; X is 41 and Y is 29; X is 41 and Y is 30; X is 41 and Y is 31; X is 41 and Y is 32; X is 41 and Y is 33; X is 41 and Y is 34; X is 41 and Y is 35; X is 41 and Y is 36; X is 41 and Y is 37; X is 41 and Y is 38; X is 41 and Y is 39; X is 41 and Y is 40; X is 41 and Y is 41; X is 41 and Y is 42; X is 41 and Y is 43; X is 41 and Y is 44; X is 41 and Y is 45; X is 41 and Y is 46; X is 41 and Y is 47; X is 41 and Y is 48; X is 41 and Y is 49; X is 41 and Y is 50; X is 41 and Y is 51; X is 41 and Y is 52; X is 41 and Y is 53; X is 41 and Y is 54; X is 41 and Y is 55; X is 41 and Y is 56; X is 41 and Y is 57; X is 41 and Y is 58; X is 41 and Y is 59; X is 41 and Y is 60; X is 41 and Y is 61; X is 41 and Y is 62; X is 41 and Y is 63; X is 41 and Y is 64; X is 41 and Y is 65; X is 41 and Y is 66; X is 41 and Y is 67; X is 41 and Y is 68; X is 41 and Y is 69; X is 41 and Y is 70; X is 41 and Y is 71; X is 41 and Y is 72; X is 41 and Y is 73; X is 41 and Y is 74; X is 41 and Y is 75; X is 41 and Y is 76; is 41 and Y is 77; X is 41 and Y is 78; X is 41 and Y is 79; X is 41 and Y is 80; X is 41 and Y is 81; X is 41 and Y is 82; X is 41 and Y is 83; X is 41 and Y is 84; X is 41 and Y is 85; X is 41 and Y is 86; X is 41 and Y is 87; X is 41 and Y is 88; X is 41 and Y is 89; X is 41 and Y is 90; X is 41 and Y is 91; X is 41 and Y is 92; X is 41 and Y is 93; X is 41 and Y is 94; X is 41 and Y is 95; X is 41 and Y is 96; X is 41 and Y is 97; X is 41 and Y is 98; X is 41 and Y is 99; X is 41 and Y is 100; X is 41 and Y is 101; X is 41 and Y is 102; X is 41 and Y is 103; X is 41 and Y is 104; X is 41 and Y is 105; X is 41 and Y is 106; X is 41 and Y is 107; X is 41 and Y is 108; X is 41 and Y is 109; X is 41 and Y is 110; X is 41 and Y is 111; X is 41 and Y is 112; X is 41 and Y is 113; X is 41 and Y is 114; X is 41 and Y is 115; X is 41 and Y is 116; X is 41 and Y is 117; X is 41 and Y is 118; X is 41 and Y is 119; X is 41 and Y is 120; X is 41 and Y is 121; X is 41 and Y is 122; X is 41 and Y is 123; X is 41 and Y is 124; X is 41 and Y is 125; X is 41 and Y is 126; X is 41 and Y is 127; X is 41 and Y is 128; X is 41 and Y is 129; X is 41 and Y is 130; X is 41 and Y is 131; X is 41 and Y is 132; X is 41 and Y is 133; X is 41 and Y is 134; X is 41 and Y is 135; X is 41 and Y is 136; X is 41 and Y is 137; X is 41 and Y is 138; X is 41 and Y is 139; X is 41 and Y is 140; X is 41 and Y is 141; X is 41 and Y is 142; X is 41 and Y is 143; X is 41 and Y is 144; X is 41 and Y is 145; X is 41 and Y is 146; X is 41 and Y is 147; X is 41 and Y is 148; X is 41 and Y is 149; X is 41 and Y is 150; X is 41 and Y is 151; X is 41 and Y is 152; X is 41 and Y is 153; X is 41 and Y is 154; X is 41 and Y is 155; X is 41 and Y is 156; X is 41 and Y is 157; X is 41 and Y is 158; X is 41 and Y is 159; X is 41 and Y is 160; X is 41 and Y is 161; X is 41 and Y is 162; X is 41 and Y is 163; X is 41 and Y is 164; X is 41 and Y is 165; X is 41 and Y is 166; X is 41 and Y is 167; X is 41 and Y is 168; X is 41 and Y is 169; X is 41 and Y is 170; X is 41 and Y is 171; X is 41 and Y is 171; X is 41 and Y is 173; X is 41 and Y is 174; X is 41 and Y is 175; X is 41 and Y is 176; X is 41 and Y is 177; X is 41 and Y is 178; X is 41 and Y is 179; X is 41 and Y is 180; X is 41 and Y is 181; X is 41 and Y is 182; X is 41 and Y is 183; X is 41 and Y is 184; X is 41 and Y is 185; X is 41 and Y is 186;

X is 42 and Y is 1; X is 42 and Y is 2; X is 42 and Y is 3; X is 42 and Y is 4; X is 42 and Y is 5; X is 42 and Y is 6; X is 42 and Y is 7; X is 42 and Y is 8; X is 42 and Y is 9; X is 42 and Y is 10; X is 42 and Y is 11; X is 42 and Y is 12; X is 42 and Y is 13; X is 42 and Y is 14; X is 42 and Y is 15; X is 42 and Y is 16; X is 42 and Y is 17; X is 42 and Y is 18; X is 42 and Y is 19; X is 42 and Y is 20; X is 42 and Y is 21; X is 42 and Y is 22; X is 42 and Y is 23; X is 42 and Y is 24; X is 42 and Y is 25; X is 42 and Y is 26; X is 42 and Y is 27; X is 42 and Y is 28; X is 42 and Y is 29; X is 42 and Y is 30; X is 42 and Y is 31; X is 42 and Y is 32; X is 42 and Y is 33; X is 42 and Y is 34; X is 42 and Y is 35; X is 42 and Y is 36; X is 42 and Y is 37; X is 42 and Y is 38; X is 42 and Y is 39; X is 42 and Y is 40; X is 42 and Y is 41; X is 42 and Y is 42; X is 42 and Y is 43; X is 42 and Y is 44; X is 42 and Y is 45; X is 42 and Y is 46; X is 42 and Y is 47; X is 42 and Y is 48; X is 42 and Y is 49; X is 42 and Y is 50; X is 42 and Y is 51; X is 42 and Y is 52; X is 42 and Y is 53; X is 42 and Y is 54; X is 42 and Y is 55; X is 42 and Y is 56; X is 42 and Y is 57; X is 42 and Y is 58; X is 42 and Y is 59; X is 42 and Y is 60; X is 42 and Y is 61; X is 42 and Y is 62; X is 42 and Y is 63; X is 42 and Y is 64; X is 42 and Y is 65; X is 42 and Y is 66; X is 42 and Y is 67; X is 42 and Y is 68; X is 42 and Y is 69; X is 42 and Y is 70; X is 42 and Y is 71; X is 42 and Y is 72; X is 42 and Y is 73; X is 42 and Y is 74; X is 42 and Y is 75; X is 42 and Y is 76; X is 42 and Y is 77; X is 42 and Y is 78; X is 42 and Y is 79; X is 42 and Y is 80; X is 42 and Y is 81; X is 42 and Y is 82; X is 42 and Y is 83; X is 42 and Y is 84; X is 42 and Y is 85; X is 42 and Y is 86; X is 42 and Y is 87; X is 42 and Y is 88; X is 42 and Y is 89; X is 42 and Y is 90; X is 42 and Y is 91; X is 42 and Y is 92; X is 42 and Y is 93; X is 42 and Y is 94; X is 42 and Y is 95; X is 42 and Y is 96; X is 42 and Y is 97; X is 42 and Y is 98; X is 42 and Y is 99; X is 42 and Y is 100; X is 42 and Y is 101; X is 42 and Y is 102; X is 42 and Y is 103; X is 42 and Y is 104; X is 42 and Y is 105; X is 42 and Y is 106; X is 42 and Y is 107; X is 42 and Y is 108; X is 42 and Y is 109; X is 42 and Y is 110; X is 42 and Y is 111; X is 42 and Y is 112; X is 42 and Y is 113; X is 42 and Y is 114; X is 42 and Y is 115; X is 42 and Y is 116; X is 42 and Y is 117; X is 42 and Y is 118; X is 42 and Y is 119; X is 42 and Y is 120; X is 42 and Y is 121; X is 42 and Y is 122; X is 42 and Y is 123; X is 42 and Y is 124; X is 42 and Y is 125; X is 42 and Y is 126; X is 42 and Y is 127; X is 42 and Y is 128; X is 42 and Y is 129; X is 42 and Y is 130; X is 42 and Y is 131; X is 42 and Y is 132; X is 42 and Y is 133; X is 42 and Y is 134; X is 42 and Y is 135; X is 42 and Y is 136; X is 42 and Y is 137; X is 42 and Y is 138; X is 42 and Y is 139; X is 42 and Y is 140; X is 42 and Y is 141; X is 42 and Y is 142; X is 42 and Y is 143; X is 42 and Y is 144; X is 42 and Y is 145; X is 42 and Y is 146; X is 42 and Y is 147; X is 42 and Y is 148; X is 42 and Y is 149; X is 42 and Y is 150; X is 42 and Y is 151; X is 42 and Y is 152; X is 42 and Y is 153; X is 42 and Y is 154; X is 42 and Y is 155; X is 42 and Y is 156; X is 42 and Y is 157; X is 42 and Y is 158; X is 42 and Y is 159; X is 42 and Y is 160; X is 42 and Y is 161; X is 42 and Y is 162; X is 42 and Y is 163; X is 42 and Y is 164; X is 42 and Y is 165; X is 42 and Y is 166; X is 42 and Y is 167; X is 42 and Y is 168; X is 42 and Y is 169; X is 42 and Y is 170; X is 42 and Y is 171; X is 42 and Y is 172; X is 42 and Y is 173; X is 42 and Y is 174; X is 42 and Y is 175; X is 42 and Y is 176; X is 42 and Y is 177; X is 42 and Y is 178; X is 42 and Y is 179; X is 42 and Y is 180; X is 42 and Y is 181; X is 42 and Y is 182; X is 42 and Y is 183; X is 42 and Y is 184; X is 42 and Y is 185; X is 42 and Y is 186;

X is 43 and Y is 1; X is 43 and Y is 2; X is 43 and Y is 3; X is 43 and Y is 4; X is 43 and Y is 5; X is 43 and Y is 6; X is 43 and Y is 7; X is 43 and Y is 8; X is 43 and Y is 9; X is 43 and Y is 10; X is 43 and Y is 11; X is 43 and Y is 12; X is 43 and Y is 13; X is 43 and Y is 14; X is 43 and Y is 15; X is 43 and Y is 16; X is 43 and Y is 17; X is 43 and Y is 18; X is 43 and Y is 19; X is 43 and Y is 20; X is 43 and Y is 21; X is 43 and Y is 22; X is 43 and Y is 23; X is 43 and Y is 24; X is 43 and Y is 25; X is 43 and Y is 26; X is 43 and Y is 27; X is 43 and Y is 28; X is 43 and Y is 29; X is 43 and Y is 30; X is 43 and Y is 31; X is 43 and Y is 32; X is 43 and is 33; X is 43 and Y is 34; X is 43 and Y is 35; X is 43 and Y is 36; X is 43 and Y is 37; X is 43 and Y is 38; X is 43 and Y is 39; X is 43 and Y is 40; X is 43 and Y is 41; X is 43 and Y is 42; X is 43 and Y is 43; X is 43 and Y is 44; X is 43 and Y is 45; X is 43 and Y is 46; X is 43 and Y is 47; X is 43 and Y is 48; X is 43 and Y is 49; X is 43 and Y is 50; X is 43 and Y is 51; X is 43 and Y is 57; X is 43 and Y is 53; X is 43 and Y is 54; X is 43 and Y is 55; X is 43 and Y is 56; X is 43 and Y is 57; X is 43 and Y is 58; X is 43 and Y is 59; X is 43 and Y is 60; X is 43 and Y is 61; X is 43 and Y is 62; X is 43 and Y is 63; X is 43 and Y is 64; X is 43 and Y is 65; X is 43 and Y is 66; X is 43 and Y is 67; X is 43 and Y is 68; X is 43 and Y is 69; X is 43 and Y is 70; X is 43 and Y is 71; X is 43 and Y is 72; X is 43 and Y is 73; X is 43 and Y is 74; X is 43 and Y is 75; X is 43 and Y is 76; X is 43 and Y is 77; X is 43 and Y is 78; X is 43 and Y is 79; X is 43 and Y is 80; X is 43 and Y is 81; X is 43 and Y is 82; X is 43 and Y is 83; X is 43 and Y is 84; X is 43 and Y is 85; X is 43 and Y is 86; X is 43 and Y is 87; X is 43 and Y is 88; X is 43 and Y is 89; X is 43 and Y is 90; X is 43 and Y is 91; X is 43 and Y is 92; X is 43 and Y is 93; X is 43 and Y is 94; X is 43 and Y is 95; X is 43 and Y is 96; X is 43 and Y is 97; X is 43 and Y is 98; X is 43 and Y is 99; X is 43 and Y is 100; X is 43 and Y is 101; X is 43 and Y is 102; X is 43 and Y is 103; X is 43 and Y is 104; X is 43 and Y is 105; X is 43 and Y is 106; X is 43 and Y is 107; X is 43 and Y is 108; X is 43 and Y is 109; X is 43 and Y is 110; X is 43 and Y is 111; X is 43 and Y is 111; X is 43 and Y is 111; X is 43 and Y is 114; X is 43 and Y is 115; X is 43 and Y is 116; X is 43 and Y is 117; X is 43 and Y is 118; X is 43 and Y is 119; X is 43 and Y is 120; X is 43 and Y is 121; X is 43 and Y is 122; X is 43 and Y is 123; X is 43 and Y is 124; X is 43 and Y is 125; X is 43 and Y is 126; X is 43 and Y is 127; X is 43 and Y is 128; X is 43 and Y is 129; X is 43 and Y is 130; X is 43 and Y is 131; X is 43 and Y is 132; X is 43 and Y is 133; X is 43 and Y is 134; X is 43 and Y is 135; X is 43 and Y is 136; X is 43 and Y is 137; X is 43 and Y is 138; X is 43 and Y is 139; X is 43 and Y is 140; X is 43 and Y is 141; X is 43 and Y is 142; X is 43 and Y is 143; X is 43 and Y is 144; X is 43 and Y is 145; X is 43 and Y is 146; X is 43 and Y is 147; X is 43 and Y is 148; X is 43 and Y is 149; X is 43 and Y is 150; X is 43 and Y is 151; X is 43 and Y is 152; X is 43 and Y is 153; X is 43 and Y is 154; X is 43 and Y is 155; X is 43 and Y is 156; X is 43 and Y is 157; X is 43 and Y is 158; X is 43 and Y is 159; X is 43 and Y is 160; X is 43 and Y is 161; X is 43 and Y is 162; X is 43 and Y is 163; X is 43 and Y is 164; X is 43 and Y is 165; X is 43 and Y is 166; X is 43 and Y is 167; X is 43 and Y is 168; X is 43 and Y is 169; X is 43 and Y is 170; X is 43 and Y is 171; X is 43 and Y is 172; X is 43 and Y is 173; X is 43 and Y is 174; X is 43 and Y is 175; X is 43 and Y is 176; X is 43 and Y is 177; X is 43 and Y is 178; X is 43 and Y is 179; X is 43 and Y is 180; X is 43 and Y is 181; X is 43 and Y is 182; X is 43 and Y is 183; X is 43 and Y is 184; X is 43 and Y is 185; X is 43 and Y is 186;

X is 44 and Y is 1; X is 44 and Y is 2; X is 44 and Y is 3; X is 44 and Y is 4; X is 44 and Y is 5; X is 44 and Y is 6; X is 44 and Y is 7; X is 44 and Y is 8; X is 44 and Y is 9; X is 44 and Y is 10; X is 44 and Y is 11; X is 44 and Y is 12; X is 44 and Y is 13; X is 44 and Y is 14; X is 44 and Y is 15; X is 44 and Y is 16; X is 44 and Y is 17; X is 44 and Y is 18; X is 44 and Y is 19; X is 44 and Y is 20; X is 44 and Y is 21; X is 44 and Y is 22; X is 44 and Y is 23; X is 44 and Y is 24; X is 44 and Y is 25; X is 44 and Y is 26; X is 44 and Y is 27; X is 44 and Y is 28; X is 44 and Y is 29; X is 44 and Y is 30; X is 44 and Y is 31; X is 44 and Y is 32; X is 44 and Y is 33; X is 44 and Y is 34; X is 44 and Y is 35; X is 44 and Y is 36; X is 44 and Y is 37; X is 44 and Y is 38; X is 44 and Y is 39; X is 44 and Y is 40; X is 44 and Y is 41; X is 44 and Y is 42; X is 44 and Y is 43; X is 44 and Y is 44; X is 44 and Y is 45; X is 44 and Y is 46; X is 44 and Y is 47; X is 44 and Y is 48; X is 44 and Y is 49; X is 44 and Y is 50; X is 44 and Y is 51; X is 44 and Y is 52; X is 44 and Y is 53; X is 44 and Y is 54; X is 44 and Y is 55; X is 44 and Y is 56; X is 44 and Y is 57; X is 44 and Y is 58; X is 44 and Y is 59; X is 44 and Y is 60; X is 44 and Y is 61; X is 44 and Y is 62; X is 44 and Y is 63; X is 44 and Y is 64; X is 44 and Y is 65; X is 44 and Y is 66; X is 44 and Y is 67; X is 44 and Y is 68; X is 44 and Y is 69; X is 44 and Y is 70; X is 44 and Y is 71; X is 44 and Y is 72; X is 44 and Y is 73; X is 44 and Y is 74; X is 44 and Y is 75; X is 44 and Y is 76; X is 44 and Y is 77; X is 44 and Y is 78; X is 44 and Y is 79; X is 44 and Y is 80; X is 44 and Y is 81; X is 44 and Y is 82; X is 44 and Y is 83; X is 44 and Y is 84; X is 44 and Y is 85; X is 44 and Y is 86; X is 44 and Y is 87; X is 44 and Y is 88; X is 44 and Y is 89; X is 44 and Y is 90; X is 44 and Y is 91; X is 44 and Y is 92; X is 44 and Y is 93; X is 44 and Y is 94; X is 44 and Y is 95; X is 44 and Y is 96; X is 44 and Y is 97; X is 44 and Y is 98; X is 44 and Y is 99; X is 44 and Y is 100; X is 44 and Y is 101; X is 44 and Y is 102; X is 44 and Y is 103; X is 44 and Y is 104; X is 44 and Y is 105; X is 44 and Y is 106; X is 44 and Y is 107; X is 44 and Y is 108; X is 44 and Y is 109; X is 44 and Y is 110; X is 44 and Y is 111; X is 44 and Y is 112; X is 44 and Y is 113; X is 44 and Y is 114; X is 44 and Y is 115; X is 44 and Y is 116; X is 44 and Y is 117; X is 44 and Y is 118; X is 44 and Y is 119; X is 44 and Y is 120; X is 44 and Y is 121; X is 44 and Y is 122; X is 44 and Y is 123; X is 44 and Y is 124; X is 44 and Y is 125; X is 44 and Y is 126; X is 44 and Y is 127; X is 44 and Y is 128; X is 44 and Y is 129; X is 44 and Y is 130; X is 44 and Y is 131; X is 44 and Y is 132; X is 44 and Y is 133; X is 44 and Y is 134; X is 44 and Y is 135; X is 44 and Y is 136; X is 44 and Y is 137; X is 44 and Y is 138; X is 44 and Y is 139; X is 44 and Y is 140; X is 44 and Y is 141; X is 44 and Y is 142; X is 44 and Y is 143; X is 44 and Y is 144; X is 44 and Y is 145; X is 44 and Y is 146; X is 44 and Y is 147; X is 44 and Y is 148; X is 44 and Y is 149; X is 44 and Y is 150; X is 44 and Y is 151; X is 44 and Y is 152; X is 44 and Y is 153; X is 44 and Y is 154; X is 44 and Y is 155; X is 44 and Y is 156; X is 44 and Y is 157; X is 44 and Y is 158; X is 44 and Y is 159; X is 44 and is 160; X is 44 and Y is 161; X is 44 and Y is 162; X is 44 and Y is 163; X is 44 and Y is 164; X is 44 and Y is 165; X is 44 and Y is 166; X is 44 and Y is 167; X is 44 and Y is 168; X is 44 and Y is 169; X is 44 and Y is 170; X is 44 and Y is 171; X is 44 and Y is 172; X is 44 and Y is 173; X is 44 and Y is 174; X is 44 and Y is 175; X is 44 and Y is 176; X is 44 and Y is 177; X is 44 and Y is 178; X is 44 and Y is 179; X is 44 and Y is 180; X is 44 and Y is 181; X is 44 and Y is 182; X is 44 and Y is 183; X is 44 and Y is 184; X is 44 and Y is 185; X is 44 and Y is 186;

X is 45 and Y is 1; X is 45 and Y is 2; X is 45 and Y is 3; X is 45 and Y is 4; X is 45 and Y is 5; X is 45 and Y is 6; X is 45 and Y is 7; X is 45 and Y is 8; X is 45 and Y is 9; X is 45 and Y is 10; X is 45 and Y is 11; X is 45 and Y is 12; X is 45 and Y is 13; X is 45 and Y is 14; X is 45 and Y is 15; X is 45 and Y is 16; X is 45 and Y is 17; X is 45 and Y is 18; X is 45 and Y is 19; X is 45 and Y is 20; X is 45 and Y is 21; X is 45 and Y is 22; X is 45 and Y is 23; X is 45 and Y is 24; X is 45 and Y is 25; X is 45 and Y is 26; X is 45 and Y is 27; X is 45 and Y is 28; X is 45 and Y is 29; X is 45 and Y is 30; X is 45 and Y is 31; X is 45 and Y is 32; X is 45 and Y is 33; X is 45 and Y is 34; X is 45 and Y is 35; X is 45 and Y is 36; X is 45 and Y is 37; X is 45 and Y is 38; X is 45 and Y is 39; X is 45 and Y is 40; X is 45 and Y is 41; X is 45 and Y is 42; X is 45 and Y is 43; X is 45 and Y is 44; X is 45 and Y is 45; X is 45 and Y is 46; X is 45 and Y is 47; X is 45 and Y is 48; X is 45 and Y is 49; X is 45 and Y is 50; X is 45 and Y is 51; X is 45 and Y is 52; X is 45 and Y is 53; X is 45 and Y is 54; X is 45 and Y is 55; X is 45 and Y is 56; X is 45 and Y is 57; X is 45 and Y is 58; X is 45 and Y is 59; X is 45 and Y is 60; X is 45 and Y is 61; X is 45 and Y is 62; X is 45 and Y is 63; X is 45 and Y is 64; X is 45 and Y is 65; X is 45 and Y is 66; X is 45 and Y is 67; X is 45 and Y is 68; X is 45 and Y is 69; X is 45 and Y is 70; X is 45 and Y is 71; X is 45 and Y is 72; X is 45 and Y is 73; X is 45 and Y is 74; X is 45 and Y is 75; X is 45 and Y is 76; X is 45 and Y is 77; X is 45 and Y is 78; X is 45 and Y is 79; X is 45 and Y is 80; X is 45 and Y is 81; X is 45 and Y is 82; X is 45 and Y is 83; X is 45 and Y is 84; X is 45 and Y is 85; X is 45 and Y is 86; X is 45 and Y is 87; X is 45 and Y is 88; X is 45 and Y is 89; X is 45 and Y is 90; X is 45 and Y is 91; X is 45 and Y is 92; X is 45 and Y is 93; X is 45 and Y is 94; X is 45 and Y is 95; X is 45 and Y is 96; X is 45 and Y is 97; X is 45 and Y is 98; X is 45 and Y is 99; X is 45 and Y is 100; X is 45 and Y is 101; X is 45 and Y is 102; X is 45 and Y is 103; X is 45 and Y is 104; X is 45 and Y is 105; X is 45 and Y is 106; X is 45 and Y is 107; X is 45 and Y is 108; X is 45 and Y is 109; X is 45 and Y is 110; X is 45 and Y is 111; X is 45 and Y is 112; X is 45 and Y is 113; X is 45 and Y is 114; X is 45 and Y is 115; X is 45 and Y is 116; X is 45 and Y is 117; X is 45 and Y is 118; X is 45 and Y is 119; X is 45 and Y is 120; X is 45 and Y is 121; X is 45 and Y is 122; X is 45 and Y is 123; X is 45 and Y is 124; X is 45 and Y is 125; X is 45 and Y is 126; X is 45 and Y is 127; X is 45 and Y is 128; X is 45 and Y is 129; X is 45 and Y is 130; X is 45 and Y is 131; X is 45 and Y is 132; X is 45 and Y is 133; X is 45 and Y is 134; X is 45 and Y is 135; X is 45 and Y is 136; X is 45 and Y is 137; X is 45 and Y is 138; X is 45 and Y is 139; X is 45 and Y is 140; X is 45 and Y is 141; X is 45 and Y is 142; X is 45 and Y is 143; X is 45 and Y is 144; X is 45 and Y is 145; X is 45 and Y is 146; X is 45 and Y is 147; X is 45 and Y is 148; X is 45 and Y is 149; X is 45 and Y is 150; X is 45 and Y is 151; X is 45 and Y is 152; X is 45 and Y is 153; X is 45 and Y is 154; X is 45 and Y is 155; X is 45 and Y is 156; X is 45 and Y is 157; X is 45 and Y is 158; X is 45 and Y is 159; X is 45 and Y is 160; X is 45 and Y is 161; X is 45 and Y is 162; X is 45 and Y is 163; X is 45 and Y is 164; X is 45 and is 165; X is 45 and Y is 166; X is 45 and Y is 167; X is 45 and Y is 168; X is 45 and Y is 169; X is 45 and Y is 170; X is 45 and Y is 171; X is 45 and Y is 172; X is 45 and Y is 173; X is 45 and Y is 174; X is 45 and Y is 175; X is 45 and Y is 176; X is 45 and Y is 177; X is 45 and Y is 178; X is 45 and Y is 179; X is 45 and Y is 180; X is 45 and Y is 181; X is 45 and Y is 182; X is 45 and Y is 183; X is 45 and Y is 184; X is 45 and Y is 185; X is 45 and Y is 186;

X is 46 and Y is 1; X is 46 and Y is 2; X is 46 and Y is 3; X is 46 and Y is 4; X is 46 and Y is 5; X is 46 and Y is 6; X is 46 and Y is 7; X is 46 and Y is 8; X is 46 and Y is 9; X is 46 and Y is 10; X is 46 and Y is 11; X is 46 and Y is 12; X is 46 and Y is 13; X is 46 and Y is 14; X is 46 and Y is 15; X is 46 and Y is 16; X is 46 and Y is 17; X is 46 and Y is 18; X is 46 and Y is 19; X is 46 and Y is 20; X is 46 and Y is 21; X is 46 and Y is 22; X is 46 and Y is 23; X is 46 and Y is 24; X is 46 and Y is 25; X is 46 and Y is 26; X is 46 and Y is 27; X is 46 and Y is 28; X is 46 and Y is 29; X is 46 and Y is 30; X is 46 and Y is 31; X is 46 and Y is 32; X is 46 and Y is 33; X is 46 and Y is 34; X is 46 and Y is 35; X is 46 and Y is 36; X is 46 and Y is 37; X is 46 and Y is 38; X is 46 and Y is 39; X is 46 and Y is 40; X is 46 and Y is 41; X is 46 and Y is 42; X is 46 and Y is 43; X is 46 and Y is 44; X is 46 and Y is 45; X is 46 and Y is 46; X is 46 and Y is 47; X is 46 and Y is 48; X is 46 and Y is 49; X is 46 and Y is 50; X is 46 and Y is 51; X is 46 and Y is 52; X is 46 and Y is 53; X is 46 and Y is 54; X is 46 and Y is 55; X is 46 and Y is 56; X is 46 and Y is 57; X is 46 and Y is 58; X is 46 and Y is 59; X is 46 and Y is 60; X is 46 and Y is 61; X is 46 and Y is 62; X is 46 and Y is 63; X is 46 and Y is 64; X is 46 and Y is 65; X is 46 and Y is 66; X is 46 and Y is 67; X is 46 and Y is 68; X is 46 and Y is 69; X is 46 and Y is 70; X is 46 and Y is 71; X is 46 and Y is 72; X is 46 and Y is 73; X is 46 and Y is 74; X is 46 and Y is 75; X is 46 and Y is 76; X is 46 and Y is 77; X is 46 and Y is 78; X is 46 and Y is 79; X is 46 and Y is 80; X is 46 and Y is 81; X is 46 and Y is 82; X is 46 and Y is 83; X is 46 and Y is 84; X is 46 and Y is 85; X is 46 and Y is 86; X is 46 and Y is 87; X is 46 and Y is 88; X is 46 and Y is 89; X is 46 and Y is 90; X is 46 and Y is 91; X is 46 and Y is 92; X is 46 and Y is 93; X is 46 and Y is 94; X is 46 and Y is 95; X is 46 and Y is 96; X is 46 and Y is 97; X is 46 and Y is 98; X is 46 and Y is 99; X is 46 and Y is 100; X is 46 and Y is 101; X is 46 and Y is 102; X is 46 and Y is 103; X is 46 and Y is 104; X is 46 and Y is 105; X is 46 and Y is 106; X is 46 and Y is 107; X is 46 and Y is 108; X is 46 and Y is 109; X is 46 and Y is 110; X is 46 and Y is 111; X is 46 and Y is 112; X is 46 and Y is 113; X is 46 and Y is 114; X is 46 and Y is 115; X is 46 and Y is 116; X is 46 and Y is 117; X is 46 and Y is 118; X is 46 and Y is 119; X is 46 and Y is 120; X is 46 and Y is 121; X is 46 and Y is 122; X is 46 and Y is 123; X is 46 and Y is 124; X is 46 and Y is 125; X is 46 and Y is 126; X is 46 and Y is 127; X is 46 and Y is 128; X is 46 and Y is 129; X is 46 and Y is 130; X is 46 and Y is 131; X is 46 and Y is 132; X is 46 and Y is 133; X is 46 and Y is 134; X is 46 and Y is 135; X is 46 and Y is 136; X is 46 and Y is 137; X is 46 and Y is 138; X is 46 and Y is 139; X is 46 and Y is 140; X is 46 and Y is 141; X is 46 and Y is 142; X is 46 and Y is 143; X is 46 and Y is 144; X is 46 and Y is 145; X is 46 and Y is 146; X is 46 and Y is 147; X is 46 and Y is 148; X is 46 and Y is 149; X is 46 and Y is 150; X is 46 and Y is 151; X is 46 and Y is 152; X is 46 and Y is 153; X is 46 and Y is 154; X is 46 and Y is 155; X is 46 and Y is 156; X is 46 and Y is 157; X is 46 and Y is 158; X is 46 and Y is 159; X is 46 and Y is 160; X is 46 and Y is 161; X is 46 and Y is 162; X is 46 and Y is 163; X is 46 and Y is 164; X is 46 and Y is 165; X is 46 and Y is 166; X is 46 and Y is 167; X is 46 and Y is 168; X is 46 and Y is 169; X is 46 and Y is 170; X is 46 and Y is 171; X is 46 and Y is 172; X is 46 and Y is 171; X is 46 and Y is 174; X is 46 and Y is 175; X is 46 and Y is 176; X is 46 and Y is 177; X is 46 and Y is 178; X is 46 and Y is 179; X is 46 and Y is 180; X is 46 and Y is 181; X is 46 and Y is 182; X is 46 and Y is 183; X is 46 and Y is 184; X is 46 and Y is 185; X is 46 and Y is 186;

X is 47 and Y is 1; X is 47 and Y is 2; X is 47 and Y is 3; X is 47 and Y is 4; X is 47 and Y is 5; X is 47 and Y is 6; X is 47 and Y is 7; X is 47 and Y is 8; X is 47 and Y is 9; X is 47 and Y is 10; X is 47 and Y is 11; X is 47 and Y is 12; X is 47 and Y is 13; X is 47 and Y is 14; X is 47 and Y is 15; X is 47 and Y is 16; X is 47 and Y is 17; X is 47 and Y is 18; X is 47 and Y is 19; X is 47 and Y is 20; X is 47 and Y is 21; X is 47 and Y is 22; X is 47 and Y is 23; X is 47 and Y is 24; X is 47 and Y is 25; X is 47 and Y is 26; X is 47 and Y is 27; X is 47 and Y is 28; X is 47 and Y is 29; X is 47 and Y is 30; X is 47 and Y is 31; X is 47 and Y is 32; X is 47 and Y is 33; X is 47 and Y is 34; X is 47 and Y is 35; X is 47 and Y is 36; X is 47 and Y is 37; X is 47 and Y is 38; X is 47 and Y is 39; X is 47 and Y is 40; X is 47 and Y is 41; X is 47 and Y is 42; X is 47 and Y is 43; X is 47 and Y is 44; X is 47 and Y is 45; X is 47 and Y is 46; X is 47 and Y is 47; X is 47 and Y is 48; X is 47 and Y is 49; X is 47 and Y is 50; X is 47 and Y is 51; X is 47 and Y is 52; X is 47 and Y is 53; X is 47 and Y is 54; X is 47 and Y is 55; X is 47 and Y is 56; X is 47 and Y is 57; X is 47 and Y is 58; X is 47 and Y is 59; X is 47 and Y is 60; X is 47 and Y is 61; X is 47 and Y is 62; X is 47 and Y is 63; X is 47 and Y is 64; X is 47 and Y is 65; X is 47 and Y is 66; X is 47 and Y is 67; X is 47 and Y is 68; X is 47 and Y is 69; X is 47 and Y is 70; X is 47 and Y is 71; X is 47 and Y is 72; X is 47 and Y is 73; X is 47 and Y is 74; X is 47 and Y is 75; X is 47 and Y is 76; X is 47 and Y is 77; X is 47 and Y is 78; X is 47 and Y is 79; X is 47 and Y is 80; X is 47 and Y is 81; X is 47 and Y is 82; X is 47 and Y is 83; X is 47 and Y is 84; X is 47 and Y is 85; X is 47 and Y is 86; X is 47 and Y is 87; X is 47 and Y is 88; X is 47 and Y is 89; X is 47 and Y is 90; X is 47 and Y is 91; X is 47 and Y is 92; X is 47 and Y is 93; X is 47 and Y is 94; X is 47 and Y is 95; X is 47 and Y is 96; X is 47 and Y is 97; X is 47 and Y is 98; X is 47 and Y is 99; X is 47 and Y is 100; X is 47 and Y is 101; X is 47 and Y is 102; X is 47 and Y is 103; X is 47 and Y is 104; X is 47 and Y is 105; X is 47 and Y is 106; X is 47 and y is 107; X is 47 and Y is 108; X is 47 and Y is 109; X is 47 and Y is 110; X is 47 and Y is 111; X is 47 and Y is 112; X is 47 and Y is 113; X is 47 and Y is 114; X is 47 and Y is 115; X is 47 and Y is 116; X is 47 and Y is 117; X is 47 and Y is 118; X is 47 and Y is 119; X is 47 and Y is 120; X is 47 and Y is 121; X is 47 and Y is 122; X is 47 and Y is 123; X is 47 and Y is 124; X is 47 and Y is 125; X is 47 and Y is 126; X is 47 and Y is 127; X is 47 and Y is 128; X is 47 and Y is 129; X is 47 and Y is 130; X is 47 and Y is 131; X is 47 and Y is 132; X is 47 and Y is 133; X is 47 and Y is 134; X is 47 and Y is 135; X is 47 and Y is 136; X is 47 and Y is 137; X is 47 and Y is 138; X is 47 and Y is 139; X is 47 and Y is 140; X is 47 and Y is 141; X is 47 and Y is 142; X is 47 and Y is 143; X is 47 and Y is 144; X is 47 and Y is 145; X is 47 and Y is 146; X is 47 and Y is 147; X is 47 and Y is 148; X is 47 and Y is 149; X is 47 and Y is 150; X is 47 and Y is 151; X is 47 and Y is 152; X is 47 and Y is 153; X is 47 and Y is 154; X is 47 and Y is 155; X is 47 and Y is 156; X is 47 and Y is 157; X is 47 and Y is 158; X is 47 and Y is 159; X is 47 and Y is 160; X is 47 and Y is 161; X is 47 and Y is 162; X is 47 and Y is 163; X is 47 and Y is 164; X is 47 and Y is 165; X is 47 and Y is 166; X is 47 and Y is 167; X is 47 and Y is 168; X is 47 and Y is 169; X is 47 and Y is 170; X is 47 and Y is 171; X is 47 and Y is 172; X is 47 and Y is 173; X is 47 and Y is 174; X is 47 and Y is 175; X is 47 and Y is 176; X is 47 and Y is 177; X is 47 and Y is 178; X is 47 and Y is 179; X is 47 and Y is 180; X is 47 and Y is 181; X is 47 and Y is 182; X is 47 and Y is 183; X is 47 and Y is 184; X is 47 and Y is 185; X is 47 and Y is 186; X is 48 and Y is 1; X is 48 and Y is 2; X is 48 and Y is 3; X is 48 and Y is 4; X is 48 and Y is 5; X is 48 and Y is 6; X is 48 and Y is 7; X is 48 and Y is 8; X is 48 and Y is 9; X is 48 and Y is 10; X is 48 and Y is 11; X is 48 and Y is 12; X is 48 and Y is 13; X is 48 and Y is 14; X is 48 and Y is 15; X is 48 and Y is 16; X is 48 and Y is 17; X is 48 and Y is 18; X is 48 and Y is 19; X is 48 and Y is 20; X is 48 and Y is 21; X is 48 and Y is 22; X is 48 and Y is 23; X is 48 and Y is 24; X is 48 and Y is 25; X is 48 and Y is 26; X is 48 and Y is 27; X is 48 and Y is 28; X is 48 and Y is 29; X is 48 and Y is 30; X is 48 and Y is 31; X is 48 and Y is 32; X is 48 and Y is 33; X is 48 and Y is 34; X is 48 and Y is 35; X is 48 and Y is 36; X is 48 and Y is 37; X is 48 and Y is 38; X is 48 and Y is 39; X is 48 and Y is 40; X is 48 and Y is 41; X is 48 and Y is 42; X is 48 and Y is 43; X is 48 and Y is 44; X is 48 and Y is 45; X is 48 and Y is 46; X is 48 and Y is 47; X is 48 and Y is 48; X is 48 and Y is 49; X is 48 and Y is 50; X is 48 and Y is 51; X is 48 and Y is 52; X is 48 and Y is 53; X is 48 and Y is 54; X is 48 and Y is 55; X is 48 and Y is 56; X is 48 and Y is 57; X is 48 and Y is 58; X is 48 and Y is 59; X is 48 and Y is 60; X is 48 and Y is 61; X is 48 and Y is 62; X is 48 and Y is 63; X is 48 and Y is 64; X is 48 and Y is 65; X is 48 and Y is 66; X is 48 and Y is 67; X is 48 and Y is 68; X is 48 and Y is 69; X is 48 and Y is 70; X is 48 and Y is 71; X is 48 and Y is 72; X is 48 and Y is 73; X is 48 and Y is 74; X is 48 and Y is 75; X is 48 and Y is 76; X is 48 and Y is 77; X is 48 and Y is 78; X is 48 and Y is 79; X is 48 and Y is 80; X is 48 and Y is 81; X is 48 and Y is 82; X is 48 and Y is 83; X is 48 and Y is 84; X is 48 and Y is 85; X is 48 and Y is 86; X is 48 and Y is 87; X is 48 and Y is 88; X is 48 and Y is 89; X is 48 and Y is 90; X is 48 and Y is 91; X is 48 and Y is 92; X is 48 and Y is 93; X is 48 and Y is 94; X is 48 and Y is 95; X is 48 and Y is 96; X is 48 and Y is 97; X is 48 and Y is 98; X is 48 and Y is 99; X is 48 and Y is 100; X is 48 and Y is 101; X is 48 and Y is 102; X is 48 and Y is 103; X is 48 and Y is 104; X is 48 and Y is 105; X is 48 and Y is 106; X is 48 and Y is 107; X is 48 and Y is 108; X is 48 and Y is 109; X is 48 and Y is 110; X is 48 and Y is 111; X is 48 and Y is 112; X is 48 and Y is 113; X is 48 and Y is 114; X is 48 and Y is 115; X is 48 and Y is 116; X is 48 and Y is 117; X is 48 and Y is 118; X is 48 and Y is 119; X is 48 and Y is 120; X is 48 and Y is 121; X is 48 and Y is 122; X is 48 and Y is 123; X is 48 and Y is 124; X is 48 and Y is 125; X is 48 and Y is 126; X is 48 and Y is 127; X is 48 and Y is 128; X is 48 and Y is 129; X is 48 and Y is 130; X is 48 and Y is 131; X is 48 and Y is 132; X is 48 and Y is 133; X is 48 and Y is 134; X is 48 and Y is 135; X is 48 and Y is 136; X is 48 and Y is 137; X is 48 and Y is 138; X is 48 and Y is 139; X is 48 and Y is 140; X is 48 and Y is 141; X is 48 and Y is 142; X is 48 and Y is 143; X is 48 and Y is 144; X is 48 and Y is 145; X is 48 and Y is 146; X is 48 and Y is 147; X is 48 and Y is 148; X is 48 and Y is 149; X is 48 and Y is 150; X is 48 and Y is 151; X is 48 and Y is 152; X is 48 and Y is 153; X is 48 and Y is 154; X is 48 and Y is 155; X is 48 and Y is 156; X is 48 and Y is 157; X is 48 and Y is 158; X is 48 and Y is 159; X is 48 and Y is 160; X is 48 and Y is 161; X is 48 and Y is 162; X is 48 and Y is 163; X is 48 and Y is 164; X is 48 and Y is 165; X is 48 and Y is 166; X is 48 and Y is 167; X is 48 and Y is 168; X is 48 and Y is 169; X is 48 and Y is 170; X is 48 and Y is 171; X is 48 and Y is 172; X is 48 and Y is 173; X is 48 and Y is 174; X is 48 and Y is 175; X is 48 and Y is 176; X is 48 and Y is 177; X is 48 and Y is 178; X is 48 and Y is 179; X is 48 and Y is 180; X is 48 and Y is 181; X is 48 and Y is 182; X is 48 and Y is 183; X is 48 and Y is 184; X is 48 and Y is 185; X is 48 and Y is 186; X is 49 and Y is 1; X is 49 and Y is 2; X is 49 and Y is 3; X is 49 and Y is 4; X is 49 and Y is 5; X is 49 and Y is 6; X is 49 and Y is 7; X is 49 and Y is 8; X is 49 and Y is 9; X is 49 and Y is 10; X is 49 and Y is 11; X is 49 and Y is 12; X is 49 and Y is 13; X is 49 and Y is 14; X is 49 and Y is 15; X is 49 and Y is 16; X is 49 and Y is 17; X is 49 and Y is 18; X is 49 and Y is 19; X is 49 and Y is 20; X is 49 and Y is 21; X is 49 and Y is 22; X is 49 and Y is 23; X is 49 and Y is 24; X is 49 and Y is 25; X is 49 and Y is 26; X is 49 and Y is 27; X is 49 and Y is 28; X is 49 and Y is 29; X is 49 and Y is 30; X is 49 and Y is 31; X is 49 and Y is 32; X is 49 and Y is 33; X is 49 and Y is 34; X is 49 and Y is 35; X is 49 and Y is 36; X is 49 and Y is 37; X is 49 and Y is 38; X is 49 and Y is 39; X is 49 and Y is 40; X is 49 and Y is 41; X is 49 and Y is 42; X is 49 and Y is 43; X is 49 and Y is 44; X is 49 and Y is 45; X is 49 and Y is 46; X is 49 and Y is 47; X is 49 and Y is 48; X is 49 and Y is 49; X is 49 and Y is 50; X is 49 and Y is 51; X is 49 and Y is 52; X is 49 and Y is 53; X is 49 and Y is 54; X is 49 and Y is 55; X is 49 and Y is 56; X is 49 and Y is 57; X is 49 and Y is 58; X is 49 and Y is 59; X is 49 and Y is 60; X is 49 and Y is 61; X is 49 and Y is 62; X is 49 and Y is 63; X is 49 and Y is 64; X is 49 and Y is 65; X is 49 and Y is 66; X is 49 and Y is 67; X is 49 and Y is 68; X is 49 and Y is 69; X is 49 and Y is 70; X is 49 and Y is 71; X is 49 and Y is 72; X is 49 and Y is 73; X is 49 and Y is 74; X is 49 and Y is 75; X is 49 and Y is 76; X is 49 and Y is 77; X is 49 and Y is 78; X is 49 and Y is 79; X is 49 and Y is 80; X is 49 and Y is 81; X is 49 and Y is 82; X is 49 and Y is 83; X is 49 and Y is 84; X is 49 and Y is 85; X is 49 and Y is 86; X is 49 and Y is 87; X is 49 and Y is 88; X is 49 and Y is 89; X is 49 and Y is 90; X is 49 and Y is 91; X is 49 and Y is 92; X is 49 and Y is 93; X is 49 and Y is 94; X is 49 and Y is 95; X is 49 and Y is 96; X is 49 and Y is 97; X is 49 and Y is 98; X is 49 and Y is 99; X is 49 and Y is 100; X is 49 and Y is 101; X is 49 and Y is 102; X is 49 and Y is 103; X is 49 and Y is 104; X is 49 and Y is 105; X is 49 and Y is 106; X is 49 and Y is 107; X is 49 and Y is 108; X is 49 and Y is 109; X is 49 and Y is 110; X is 49 and Y is 111; X is 49 and Y is 112; X is 49 and Y is 113; X is 49 and Y is 114; X is 49 and Y is 115; X is 49 and Y is 116; X is 49 and Y is 117; X is 49 and Y is 118; X is 49 and Y is 119; X is 49 and Y is 120; X is 49 and Y is 121; X is 49 and Y is 122; X is 49 and Y is 123; X is 49 and Y is 124; X is 49 and Y is 125; X is 49 and Y is 126; X is 49 and Y is 127; X is 49 and Y is 128; X is 49 and Y is 129; X is 49 and Y is 130; X is 49 and Y is 131; X is 49 and Y is 132; X is 49 and Y is 133; X is 49 and Y is 134; X is 49 and Y is 135; X is 49 and Y is 136; X is 49 and Y is 137; X is 49 and Y is 138; X is 49 and Y is 139; X is 49 and Y is 140; X is 49 and Y is 141; X is 49 and Y is 142; X is 49 and Y is 143; X is 49 and Y is 144; X is 49 and Y is 145; X is 49 and Y is 146; X is 49 and Y is 147; X is 49 and Y is 148; X is 49 and Y is 149; X is 49 and Y is 150; X is 49 and Y is 151; X is 49 and Y is 152; X is 49 and Y is 153; X is 49 and Y is 154; X is 49 and Y is 155; X is 49 and Y is 156; X is 49 and Y is 157; X is 49 and Y is 158; X is 49 and Y is 159; X is 49 and Y is 160; X is 49 and Y is 161; X is 49 and Y is 162; X is 49 and Y is 163; X is 49 and Y is 164; X is 49 and Y is 165; X is 49 and Y is 166; X is 49 and Y is 167; X is 49 and Y is 168; X is 49 and Y is 169; X is 49 and Y is 170; X is 49 and Y is 171; X is 49 and Y is 172; X is 49 and Y is 173; X is 49 and Y is 174; X is 49 and Y is 175; X is 49 and Y is 176; X is 49 and Y is 177; X is 49 and Y is 178; X is 49 and Y is 179; X is 49 and Y is 180; X is 49 and Y is 181; X is 49 and Y is 182; X is 49 and Y is 183; X is 49 and Y is 184; X is 49 and Y is 185; X is 49 and Y is 186; X is 50 and Y is 1; X is 50 and Y is 2; X is 50 and Y is 3; X is 50 and Y is 4; X is 50 and Y is 5; X is 50 and Y is 6; X is 50 and Y is 7; X is 50 and Y is 8; X is 50 and Y is 9; X is 50 and Y is 10; X is 50 and Y is 11; X is 50 and Y is 12; X is 50 and Y is 13; X is 50 and Y is 14; X is 50 and Y is 15; X is 50 and Y is 16; X is 50 and Y is 17; X is 50 and Y is 18; X is 50 and Y is 19; X is 50 and Y is 20; X is 50 and Y is 21; X is 50 and Y is 22; X is 50 and Y is 23; X is 50 and Y is 24; X is 50 and Y is 25; X is 50 and Y is 26; X is 50 and Y is 27; X is 50 and Y is 28; X is 50 and Y is 29; X is 50 and Y is 30; X is 50 and Y is 31; X is 50 and Y is 32; X is 50 and Y is 33; X is 50 and Y is 34; X is 50 and Y is 35; X is 50 and Y is 36; X is 50 and Y is 37; X is 50 and Y is 38; X is 50 and Y is 39; X is 50 and Y is 40; X is 50 and Y is 41; X is 50 and Y is 42; X is 50 and Y is 43; X is 50 and Y is 44; X is 50 and Y is 45; X is 50 and Y is 46; X is 50 and Y is 47; X is 50 and Y is 48; X is 50 and Y is 49; X is 50 and Y is 50; X is 50 and Y is 51; X is 50 and Y is 52; X is 50 and Y is 53; X is 50 and Y is 54; X is 50 and Y is 55; X is 50 and Y is 56; X is 50 and Y is 57; X is 50 and Y is 58; X is 50 and Y is 59; X is 50 and Y is 60; X is 50 and Y is 61; X is 50 and Y is 62; X is 50 and Y is 63; X is 50 and Y is 64; X is 50 and Y is 65; X is 50 and Y is 66; X is 50 and Y is 67; X is 50 and Y is 68; X is 50 and Y is 69; X is 50 and Y is 70; X is 50 and Y is 71; X is 50 and Y is 72; X is 50 and Y is 73; X is 50 and Y is 74; X is 50 and Y is 75; X is 50 and Y is 76; X is 50 and Y is 77; X is 50 and Y is 78; X is 50 and Y is 79; X is 50 and Y is 80; X is 50 and Y is 81; X is 50 and Y is 82; X is 50 and Y is 83; X is 50 and Y is 84; X is 50 and Y is 85; X is 50 and Y is 86; X is 50 and Y is 87; X is 50 and Y is 88; X is 50 and Y is 89; X is 50 and Y is 90; X is 50 and Y is 91; X is 50 and Y is 92; X is 50 and Y is 93; X is 50 and Y is 94; X is 50 and Y is 95; X is 50 and Y is 96; X is 50 and Y is 97; X is 50 and Y is 98; X is 50 and Y is 99; X is 50 and Y is 100; X is 50 and Y is 101; X is 50 and Y is 102; X is 50 and Y is 103; X is 50 and Y is 104; X is 50 and Y is 105; X is 50 and Y is 106; X is 50 and Y is 107; X is 50 and Y is 108; X is 50 and Y is 109; X is 50 and Y is 110; X is 50 and Y is 111; X is 50 and Y is 112; X is 50 and Y is 113; X is 50 and Y is 114; X is 50 and Y is 115; X is 50 and Y is 116; X is 50 and Y is 117; X is 50 and Y is 118; X is 50 and Y is 119; X is 50 and Y is 120; X is 50 and Y is 121; X is 50 and Y is 122; X is 50 and Y is 123; X is 50 and Y is 124; X is 50 and Y is 125; X is 50 and Y is 126; X is 50 and Y is 127; X is 50 and Y is 128; X is 50 and Y is 129; X is 50 and Y is 130; X is 50 and Y is 131; X is 50 and Y is 132; X is 50 and Y is 133; X is 50 and Y is 134; X is 50 and Y is 135; X is 50 and Y is 136; X is 50 and Y is 137; X is 50 and Y is 138; X is 50 and Y is 139; X is 50 and Y is 140; X is 50 and Y is 141; X is 50 and Y is 142; X is 50 and Y is 143; X is 50 and Y is 144; X is 50 and Y is 145; X is 50 and Y is 146; X is 50 and Y is 147; X is 50 and Y is 148; X is 50 and Y is 149; X is 50 and Y is 150; X is 50 and Y is 151; X is 50 and Y is 152; X is 50 and Y is 153; X is 50 and Y is 154; X is 50 and Y is 155; X is 50 and Y is 156; X is 50 and Y is 157; X is 50 and Y is 158; X is 50 and Y is 159; X is 50 and Y is 160; X is 50 and Y is 161; X is 50 and Y is 162; X is 50 and Y is 163; X is 50 and Y is 164; X is 50 and Y is 165; X is 50 and Y is 166; X is 50 and Y is 167; X is 50 and Y is 168; X is 50 and Y is 169; X is 50 and Y is 170; X is 50 and Y is 171; X is 50 and Y is 172; X is 50 and Y is 173; X is 50 and Y is 174; X is 50 and Y is 175; X is 50 and Y is 176; X is 50 and Y is 177; X is 50 and Y is 178; X is 50 and Y is 179; X is 50 and Y is 180; X is 50 and Y is 181; X is 50 and Y is 182; X is 50 and Y is 183; X is 50 and Y is 184; X is 50 and Y is 185; X is 50 and Y is 186; X is 51 and Y is 1; X is 51 and Y is 2; X is 51 and Y is 3; X is 51 and Y is 4; X is 51 and Y is 5; X is 51 and Y is 6; X is 51 and Y is 7; X is 51 and Y is 8; X is 51 and Y is 9; X is 51 and Y is 10; X is 51 and Y is 11; X is 51 and Y is 12; X is 51 and Y is 13; X is 51 and Y is 14; X is 51 and Y is 15; X is 51 and Y is 16; X is 51 and Y is 17; X is 51 and Y is 18; X is 51 and Y is 19; X is 51 and Y is 20; X is 51 and Y is 21; X is 51 and Y is 22; X is 51 and Y is 23; X is 51 and Y is 24; X is 51 and Y is 25; X is 51 and Y is 26; X is 51 and Y is 27; X is 51 and Y is 28; X is 51 and Y is 29; X is 51 and Y is 30; X is 51 and Y is 31; X is 51 and Y is 32; X is 51 and Y is 33; X is 51 and Y is 34; X is 51 and Y is 35; X is 51 and Y is 36; X is 51 and Y is 37; X is 51 and Y is 38; X is 51 and Y is 39; X is 51 and Y is 40; X is 51 and Y is 41; X is 51 and Y is 42; X is 51 and Y is 43; X is 51 and Y is 44; X is 51 and Y is 45; X is 51 and Y is 46; X is 51 and Y is 47; X is 51 and Y is 48; X is 51 and Y is 49; X is 51 and Y is 50; X is 51 and Y is 51; X is 51 and Y is 52; X is 51 and Y is 53; X is 51 and Y is 54; X is 51 and Y is 55; X is 51 and Y is 56; X is 51 and Y is 57; X is 51 and Y is 58; X is 51 and Y is 59; X is 51 and Y is 60; X is 51 and Y is 61; X is 51 and Y is 62; X is 51 and Y is 63; X is 51 and Y is 64; X is 51 and Y is 65; X is 51 and Y is 66; X is 51 and Y is 67; X is 51 and Y is 68; X is 51 and Y is 69; X is 51 and Y is 70; X is 51 and Y is 71; X is 51 and Y is 72; X is 51 and Y is 73; X is 51 and Y is 74; X is 51 and Y is 75; X is 51 and Y is 76; X is 51 and Y is 77; X is 51 and Y is 78; X is 51 and Y is 79; X is 51 and Y is 80; X is 51 and Y is 81; X is 51 and Y is 82; X is 51 and Y is 83; X is 51 and Y is 84; X is 51 and Y is 85; X is 51 and Y is 86; X is 51 and Y is 87; X is 51 and Y is 88; X is 51 and Y is 89; X is 51 and Y is 90; X is 51 and Y is 91; X is 51 and Y is 92; X is 51 and Y is 93; X is 51 and Y is 94; X is 51 and Y is 95; X is 51 and Y is 96; X is 51 and Y is 97; X is 51 and Y is 98; X is 51 and Y is 99; X is 51 and Y is 100; X is 51 and Y is 101; X is 51 and Y is 102; X is 51 and Y is 103; X is 51 and Y is 104; X is 51 and Y is 105; X is 51 and Y is 106; X is 51 and Y is 107; X is 51 and Y is 108; X is 51 and Y is 109; X is 51 and Y is 110; X is 51 and Y is 111; X is 51 and Y is 112; X is 51 and Y is 113; X is 51 and Y is 114; X is 51 and Y is 115; X is 51 and Y is 116; X is 51 and Y is 117; X is 51 and Y is 118; X is 51 and Y is 119; X is 51 and Y is 120; X is 51 and Y is 121; X is 51 and Y is 122; X is 51 and Y is 123; X is 51 and Y is 124; X is 51 and Y is 125; X is 51 and Y is 126; X is 51 and Y is 127; X is 51 and Y is 128; X is 51 and Y is 129; X is 51 and Y is 130; X is 51 and Y is 131; X is 51 and Y is 132; X is 51 and Y is 133; X is 51 and Y is 134; X is 51 and Y is 135; X is 51 and Y is 136; X is 51 and Y is 137; X is 51 and Y is 138; X is 51 and Y is 139; X is 51 and Y is 140; X is 51 and Y is 141; X is 51 and Y is 142; X is 51 and Y is 143; X is 51 and Y is 144; X is 51 and Y is 145; X is 51 and Y is 146; X is 51 and Y is 147; X is 51 and Y is 148; X is 51 and Y is 149; X is 51 and Y is 150; X is 51 and Y is 151; X is 51 and Y is 152; X is 51 and Y is 153; X is 51 and Y is 154; X is 51 and Y is 155; X is 51 and Y is 156; X is 51 and Y is 157; X is 51 and Y is 158; X is 51 and Y is 159; X is 51 and Y is 160; X is 51 and Y is 161; X is 51 and Y is 162; X is 51 and Y is 163; X is 51 and Y is 164; X is 51 and Y is 165; X is 51 and Y is 166; X is 51 and Y is 167; X is 51 and Y is 168; X is 51 and Y is 169; X is 51 and Y is 170; X is 51 and Y is 171; X is 51 and Y is 172; X is 51 and Y is 173; X is 51 and Y is 174; X is 51 and Y is 175; X is 51 and Y is 176; X is 51 and Y is 177; X is 51 and Y is 178; X is 51 and Y is 179; X is 51 and Y is 180; X is 51 and Y is 181; X is 51 and Y is 182; X is 51 and Y is 183; X is 51 and Y is 184; X is 51 and Y is 185; X is 51 and Y is 186; X is 52 and Y is 1; X is 52 and Y is 2; X is 52 and Y is 3; X is 52 and Y is 4; X is 52 and Y is 5; X is 52 and Y is 6; X is 52 and Y is 7; X is 52 and Y is 8; X is 52 and Y is 9; X is 52 and Y is 10; X is 52 and Y is 11; X is 52 and Y is 12; X is 52 and Y is 13; X is 52 and Y is 14; X is 52 and Y is 15; X is 52 and Y is 16; X is 52 and Y is 17; X is 52 and Y is 18; X is 52 and Y is 19; X is 52 and Y is 20; X is 52 and Y is 21; X is 52 and Y is 22; X is 52 and Y is 23; X is 52 and Y is 24; X is 52 and Y is 25; X is 52 and Y is 26; X is 52 and Y is 27; X is 52 and Y is 28; X is 52 and Y is 29; X is 52 and Y is 30; X is 52 and Y is 31; X is 52 and Y is 32; X is 52 and Y is 33; X is 52 and Y is 34; X is 52 and Y is 35; X is 52 and Y is 36; X is 52 and Y is 37; X is 52 and Y is 38; X is 52 and Y is 39; X is 52 and Y is 40; X is 52 and Y is 41; X is 52 and Y is 42; X is 52 and Y is 43; X is 52 and Y is 44; X is 52 and Y is 45; X is 52 and Y is 46; X is 52 and Y is 47; X is 52 and Y is 48; X is 52 and Y is 49; X is 52 and Y is 50; X is 52 and Y is 51; X is 52 and Y is 52; X is 52 and Y is 53; X is 52 and Y is 54; X is 52 and Y is 55; X is 52 and Y is 56; X is 52 and Y is 57; X is 52 and Y is 58; X is 52 and Y is 59; X is 52 and Y is 60; X is 52 and Y is 61; X is 52 and Y is 62; X is 52 and Y is 63; X is 52 and Y is 64; X is 52 and Y is 65; X is 52 and Y is 66; X is 52 and Y is 67; X is 52 and Y is 68; X is 52 and Y is 69; X is 52 and Y is 70; X is 52 and Y is 71; X is 52 and Y is 72; X is 52 and Y is 73; X is 52 and Y is 74; X is 52 and Y is 75; X is 52 and Y is 76; X is 52 and Y is 77; X is 52 and Y is 78; X is 52 and Y is 79; X is 52 and Y is 80; X is 52 and Y is 81; X is 52 and Y is 82; X is 52 and Y is 83; X is 52 and Y is 84; X is 52 and Y is 85; X is 52 and Y is 86; X is 52 and Y is 87; X is 52 and Y is 88; X is 52 and Y is 89; X is 52 and Y is 90; X is 52 and Y is 91; X is 52 and Y is 92; X is 52 and Y is 93; X is 52 and Y is 94; X is 52 and Y is 95; X is 52 and Y is 96; X is 52 and Y is 97; X is 52 and Y is 98; X is 52 and Y is 99; X is 52 and Y is 100; X is 52 and Y is 101; X is 52 and Y is 102; X is 52 and Y is 103; X is 52 and Y is 104; X is 52 and Y is 105; X is 52 and Y is 106; X is 52 and Y is 107; X is 52 and Y is 108; X is 52 and Y is 109; X is 52 and Y is 110; X is 52 and Y is 111; X is 52 and Y is 112; X is 52 and Y is 113; X is 52 and Y is 114; X is 52 and Y is 115; X is 52 and Y is 116; X is 52 and Y is 117; X is 52 and Y is 118; X is 52 and Y is 119; X is 52 and Y is 120; X is 52 and Y is 121; X is 52 and Y is 122; X is 52 and Y is 123; X is 52 and Y is 124; X is 52 and Y is 125; X is 52 and Y is 126; X is 52 and Y is 127; X is 52 and Y is 128; X is 52 and Y is 129; X is 52 and Y is 130; X is 52 and Y is 131; X is 52 and Y is 132; X is 52 and Y is 133; X is 52 and Y is 134; X is 52 and Y is 135; X is 52 and Y is 136; X is 52 and Y is 137; X is 52 and Y is 138; X is 52 and Y is 139; X is 52 and Y is 140; X is 52 and Y is 141; X is 52 and Y is 142; X is 52 and Y is 143; X is 52 and Y is 144; X is 52 and Y is 145; X is 52 and Y is 146; X is 52 and Y is 147; X is 52 and Y is 148; X is 52 and Y is 149; X is 52 and Y is 150; X is 52 and Y is 151; X is 52 and Y is 152; X is 52 and Y is 153; X is 52 and Y is 154; X is 52 and Y is 155; X is 52 and Y is 156; X is 52 and Y is 157; X is 52 and Y is 158; X is 52 and Y is 159; X is 52 and Y is 160; X is 52 and Y is 161; X is 52 and Y is 162; X is 52 and Y is 163; X is 52 and Y is 164; X is 52 and Y is 165; X is 52 and Y is 166; X is 52 and Y is 167; X is 52 and Y is 168; X is 52 and Y is 169; X is 52 and Y is 170; X is 52 and Y is 171; X is 52 and Y is 172; X is 52 and Y is 173; X is 52 and Y is 174; X is 52 and Y is 175; X is 52 and Y is 176; X is 52 and Y is 177; X is 52 and Y is 178; X is 52 and Y is 179; X is 52 and Y is 180; X is 52 and Y is 181; X is 52 and Y is 182; X is 52 and Y is 183; X is 52 and Y is 184; X is 52 and Y is 185; X is 52 and Y is 186; X is 53 and Y is 1; X is 53 and Y is 2; X is 53 and Y is 3; X is 53 and Y is 4; X is 53 and Y is 5; X is 53 and Y is 6; X is 53 and Y is 7; X is 53 and Y is 8; X is 53 and Y is 9; X is 53 and Y is 10; X is 53 and Y is 11; X is 53 and Y is 12; X is 53 and Y is 13; X is 53 and Y is 14; X is 53 and Y is 15; X is 53 and Y is 16; X is 53 and Y is 17; X is 53 and Y is 18; X is 53 and Y is 19; X is 53 and Y is 20; X is 53 and Y is 21; X is 53 and Y is 22; X is 53 and Y is 23; X is 53 and Y is 24; X is 53 and Y is 25; X is 53 and Y is 26; X is 53 and Y is 27; X is 53 and Y is 28; X is 53 and Y is 29; X is 53 and Y is 30; X is 53 and Y is 31; X is 53 and Y is 32; X is 53 and Y is 33; X is 53 and Y is 34; X is 53 and Y is 35; X is 53 and Y is 36; X is 53 and Y is 37; X is 53 and Y is 38; X is 53 and Y is 39; X is 53 and Y is 40; X is 53 and Y is 41; X is 53 and Y is 42; X is 53 and Y is 43; X is 53 and Y is 44; X is 53 and Y is 45; X is 53 and Y is 46; X is 53 and Y is 47; X is 53 and Y is 48; X is 53 and Y is 49; X is 53 and Y is 50; X is 53 and Y is 51; X is 53 and Y is 52; X is 53 and Y is 53; X is 53 and Y is 54; X is 53 and Y is 55; X is 53 and Y is 56; X is 53 and Y is 57; X is 53 and Y is 58; X is 53 and Y is 59; X is 53 and Y is 60; X is 53 and Y is 61; X is 53 and Y is 62; X is 53 and Y is 63; X is 53 and Y is 64; X is 53 and Y is 65; X is 53 and Y is 66; X is 53 and Y is 67; X is 53 and Y is 68; X is 53 and Y is 69; X is 53 and Y is 70; X is 53 and Y is 71; X is 53 and Y is 72; X is 53 and Y is 73; X is 53 and Y is 74; X is 53 and Y is 75; X is 53 and Y is 76; X is 53 and Y is 77; X is 53 and Y is 78; X is 53 and Y is 79; X is 53 and Y is 80; X is 53 and Y is 81; X is 53 and Y is 82; X is 53 and Y is 83; X is 53 and Y is 84; X is 53 and Y is 85; X is 53 and Y is 86; X is 53 and Y is 87; X is 53 and Y is 88; X is 53 and Y is 89; X is 53 and Y is 90; X is 53 and Y is 91; X is 53 and Y is 92; X is 53 and Y is 93; X is 53 and Y is 94; X is 53 and Y is 95; X is 53 and Y is 96; X is 53 and Y is 97; X is 53 and Y is 98; X is 53 and Y is 99; X is 53 and Y is 100; X is 53 and Y is 101; X is 53 and Y is 102; X is 53 and Y is 103; X is 53 and Y is 104; X is 53 and Y is 105; X is 53 and Y is 106; X is 53 and Y is 107; X is 53 and Y is 108; X is 53 and Y is 109; X is 53 and Y is 110; X is 53 and Y is 111; X is 53 and Y is 112; X is 53 and Y is 113; X is 53 and Y is 114; X is 53 and Y is 115; X is 53 and Y is 116; X is 53 and Y is 117; X is 53 and Y is 118; X is 53 and Y is 119; X is 53 and Y is 120; X is 53 and Y is 121; X is 53 and Y is 122; X is 53 and Y is 123; X is 53 and Y is 124; X is 53 and Y is 125; X is 53 and Y is 126; X is 53 and Y is 127; X is 53 and Y is 128; X is 53 and Y is 129; X is 53 and Y is 130; X is 53 and Y is 131; X is 53 and Y is 132; X is 53 and Y is 133; X is 53 and Y is 134; X is 53 and Y is 135; X is 53 and Y is 136; X is 53 and Y is 137; X is 53 and Y is 138; X is 53 and Y is 139; X is 53 and Y is 140; X is 53 and Y is 141; X is 53 and Y is 142; X is 53 and Y is 143; X is 53 and Y is 144; X is 53 and Y is 145; X is 53 and Y is 146; X is 53 and Y is 147; X is 53 and Y is 148; X is 53 and Y is 149; X is 53 and Y is 150; X is 53 and Y is 151; X is 53 and Y is 152; X is 53 and Y is 153; X is 53 and Y is 154; X is 53 and Y is 155; X is 53 and Y is 156; X is 53 and Y is 157; X is 53 and Y is 158; X is 53 and Y is 159; X is 53 and Y is 160; X is 53 and Y is 161; X is 53 and Y is 162; X is 53 and Y is 163; X is 53 and Y is 164; X is 53 and Y is 165; X is 53 and Y is 166; X is 53 and Y is 167; X is 53 and Y is 168; X is 53 and Y is 169; X is 53 and Y is 170; X is 53 and Y is 171; X is 53 and Y is 172; X is 53 and Y is 173; X is 53 and Y is 174; X is 53 and Y is 175; X is 53 and Y is 176; X is 53 and Y is 177; X is 53 and Y is 178; X is 53 and Y is 179; X is 53 and Y is 180; X is 53 and Y is 181; X is 53 and Y is 182; X is 53 and Y is 183; X is 53 and Y is 184; X is 53 and Y is 185; X is 53 and Y is 186; X is 54 and Y is 1; X is 54 and Y is 2; X is 54 and Y is 3; X is 54 and Y is 4; X is 54 and Y is 5; X is 54 and Y is 6; X is 54 and Y is 7; X is 54 and Y is 8; X is 54 and Y is 9; X is 54 and Y is 10; X is 54 and Y is 11; X is 54 and Y is 12; X is 54 and Y is 13; X is 54 and Y is 14; X is 54 and Y is 15; X is 54 and Y is 16; X is 54 and Y is 17; X is 54 and Y is 18; X is 54 and Y is 19; X is 54 and Y is 20; X is 54 and Y is 21; X is 54 and Y is 22; X is 54 and Y is 23; X is 54 and Y is 24; X is 54 and Y is 25; X is 54 and Y is 26; X is 54 and Y is 27; X is 54 and Y is 28; X is 54 and Y is 29; X is 54 and Y is 30; X is 54 and Y is 31; X is 54 and Y is 32; X is 54 and Y is 33; X is 54 and Y is 34; X is 54 and Y is 35; X is 54 and Y is 36; X is 54 and Y is 37; X is 54 and Y is 38; X is 54 and Y is 39; X is 54 and Y is 40; X is 54 and Y is 41; X is 54 and Y is 42; X is 54 and Y is 43; X is 54 and Y is 44; X is 54 and Y is 45; X is 54 and Y is 46; X is 54 and Y is 47; X is 54 and Y is 48; X is 54 and Y is 49; X is 54 and Y is 50; X is 54 and Y is 51; X is 54 and Y is 52; X is 54 and Y is 53; X is 54 and Y is 54; X is 54 and Y is 55; X is 54 and Y is 56; X is 54 and Y is 57; X is 54 and Y is 58; X is 54 and Y is 59; X is 54 and Y is 60; X is 54 and Y is 61; X is 54 and Y is 62; X is 54 and Y is 63; X is 54 and Y is 64; X is 54 and Y is 65; X is 54 and Y is 66; X is 54 and Y is 67; X is 54 and Y is 68; X is 54 and Y is 69; X is 54 and Y is 70; X is 54 and Y is 71; X is 54 and Y is 72; X is 54 and Y is 73; X is 54 and Y is 74; X is 54 and Y is 75; X is 54 and Y is 76; X is 54 and Y is 77; X is 54 and Y is 78; X is 54 and Y is 79; X is 54 and Y is 80; X is 54 and Y is 81; X is 54 and Y is 82; X is 54 and Y is 83; X is 54 and Y is 84; X is 54 and Y is 85; X is 54 and Y is 86; X is 54 and Y is 87; X is 54 and Y is 88; X is 54 and Y is 89; X is 54 and Y is 90; X is 54 and Y is 91; X is 54 and Y is 92; X is 54 and Y is 93; X is 54 and Y is 94; X is 54 and Y is 95; X is 54 and Y is 96; X is 54 and Y is 97; X is 54 and Y is 98; X is 54 and Y is 99; X is 54 and Y is 100; X is 54 and Y is 101; X is 54 and Y is 102; X is 54 and Y is 103; X is 54 and Y is 104; X is 54 and Y is 105; X is 54 and Y is 106; X is 54 and Y is 107; X is 54 and Y is 108; X is 54 and Y is 109; X is 54 and Y is 110; X is 54 and Y is 111; X is 54 and Y is 112; X is 54 and Y is 113; X is 54 and Y is 114; X is 54 and Y is 115; X is 54 and Y is 116; X is 54 and Y is 117; X is 54 and Y is 118; X is 54 and Y is 119; X is 54 and Y is 120; X is 54 and Y is 121; X is 54 and Y is 122; X is 54 and Y is 123; X is 54 and Y is 124; X is 54 and Y is 125; X is 54 and Y is 126; X is 54 and Y is 127; X is 54 and Y is 128; X is 54 and Y is 129; X is 54 and Y is 130; X is 54 and Y is 131; X is 54 and Y is 132; X is 54 and Y is 133; X is 54 and Y is 134; X is 54 and Y is 135; X is 54 and Y is 136; X is 54 and Y is 137; X is 54 and Y is 138; X is 54 and Y is 139; X is 54 and Y is 140; X is 54 and Y is 141; X is 54 and Y is 142; X is 54 and Y is 143; X is 54 and Y is 144; X is 54 and Y is 145; X is 54 and Y is 146; X is 54 and Y is 147; X is 54 and Y is 148; X is 54 and Y is 149; X is 54 and Y is 150; X is 54 and Y is 151; X is 54 and Y is 152; X is 54 and Y is 153; X is 54 and Y is 154; X is 54 and Y is 155; X is 54 and Y is 156; X is 54 and Y is 157; X is 54 and Y is 158; X is 54 and Y is 159; X is 54 and Y is 160; X is 54 and Y is 161; X is 54 and Y is 162; X is 54 and Y is 163; X is 54 and Y is 164; X is 54 and Y is 165; X is 54 and Y is 166; X is 54 and Y is 167; X is 54 and Y is 168; X is 54 and Y is 169; X is 54 and Y is 170; X is 54 and Y is 171; X is 54 and Y is 172; X is 54 and Y is 173; X is 54 and Y is 174; X is 54 and Y is 175; X is 54 and Y is 176; X is 54 and Y is 177; X is 54 and Y is 178; X is 54 and Y is 179; X is 54 and Y is 180; X is 54 and Y is 181; X is 54 and Y is 182; X is 54 and Y is 183; X is 54 and Y is 184; X is 54 and Y is 185; X is 54 and Y is 186; X is 55 and Y is 1; X is 55 and Y is 2; is 55 and Y is 3; X is 55 and Y is 4; X is 55 and Y is 5; X is 55 and Y is 6; X is 55 and Y is 7; X is 55 and Y is 8; X is 55 and Y is 9; X is 55 and Y is 10; X is 55 and Y is 11; X is 55 and Y is 12; X is 55 and Y is 13; X is 55 and Y is 14; X is 55 and Y is 15; X is 55 and Y is 16; X is 55 and Y is 17; X is 55 and Y is 18; X is 55 and Y is 19; X is 55 and Y is 20; X is 55 and Y is 21; X is 55 and Y is 22; X is 55 and Y is 23; X is 55 and Y is 24; X is 55 and Y is 25; X is 55 and Y is 26; X is 55 and Y is 27; X is 55 and Y is 28; X is 55 and Y is 29; X is 55 and Y is 30; X is 55 and Y is 31; X is 55 and Y is 32; X is 55 and Y is 33; X is 55 and Y is 34; X is 55 and Y is 35; X is 55 and Y is 36; X is 55 and Y is 37; X is 55 and Y is 38; X is 55 and Y is 39; X is 55 and Y is 40; X is 55 and Y is 41; X is 55 and Y is 42; X is 55 and Y is 43; X is 55 and Y is 44; X is 55 and Y is 45; X is 55 and Y is 46; X is 55 and Y is 47; X is 55 and Y is 48; X is 55 and Y is 49; X is 55 and Y is 50; X is 55 and Y is 51; X is 55 and Y is 52; X is 55 and Y is 53; X is 55 and Y is 54; X is 55 and Y is 55; X is 55 and Y is 56; X is 55 and Y is 57; X is 55 and Y is 58; X is 55 and Y is 59; X is 55 and Y is 60; X is 55 and Y is 61; X is 55 and Y is 62; X is 55 and Y is 63; X is 55 and Y is 64; X is 55 and Y is 65; X is 55 and Y is 66; X is 55 and Y is 67; X is 55 and Y is 68; X is 55 and Y is 69; X is 55 and Y is 70; X is 55 and Y is 71; X is 55 and Y is 72; X is 55 and Y is 73; X is 55 and Y is 74; X is 55 and Y is 75; X is 55 and Y is 76; X is 55 and Y is 77; X is 55 and Y is 78; X is 55 and Y is 79; X is 55 and Y is 80; X is 55 and Y is 81; X is 55 and Y is 82; X is 55 and Y is 83; X is 55 and Y is 84; X is 55 and Y is 85; X is 55 and Y is 86; X is 55 and Y is 87; X is 55 and Y is 88; X is 55 and Y is 89; X is 55 and Y is 90; X is 55 and Y is 91; X is 55 and Y is 92; X is 55 and Y is 93; X is 55 and Y is 94; X is 55 and Y is 95; X is 55 and Y is 96; X is 55 and Y is 97; X is 55 and Y is 98; X is 55 and Y is 99; X is 55 and Y is 100; X is 55 and Y is 101; X is 55 and Y is 102; X is 55 and Y is 103; X is 55 and Y is 104; X is 55 and Y is 105; X is 55 and Y is 106; X is 55 and Y is 107; X is 55 and Y is 108; X is 55 and Y is 109; X is 55 and Y is 110; X is 55 and Y is 111; X is 55 and Y is 112; X is 55 and Y is 113; X is 55 and Y is 114; X is 55 and Y is 115; X is 55 and Y is 116; X is 55 and Y is 117; X is 55 and Y is 118; X is 55 and Y is 119; X is 55 and Y is 120; X is 55 and Y is 121; X is 55 and Y is 122; X is 55 and Y is 123; X is 55 and Y is 124; X is 55 and Y is 125; X is 55 and Y is 126; X is 55 and Y is 127; X is 55 and Y is 128; X is 55 and Y is 129; X is 55 and Y is 130; X is 55 and Y is 131; X is 55 and Y is 132; X is 55 and Y is 133; X is 55 and Y is 134; X is 55 and Y is 135; X is 55 and Y is 136; X is 55 and Y is 137; X is 55 and Y is 138; X is 55 and Y is 139; X is 55 and Y is 140; X is 55 and Y is 141; X is 55 and Y is 142; X is 55 and Y is 143; X is 55 and Y is 144; X is 55 and Y is 145; X is 55 and Y is 146; X is 55 and Y is 147; X is 55 and Y is 148; X is 55 and Y is 149; X is 55 and Y is 150; X is 55 and Y is 151; X is 55 and Y is 152; X is 55 and Y is 153; X is 55 and Y is 154; X is 55 and Y is 155; X is 55 and Y is 156; X is 55 and Y is 157; X is 55 and Y is 158; X is 55 and Y is 159; X is 55 and Y is 160; X is 55 and Y is 161; X is 55 and Y is 162; X is 55 and Y is 163; X is 55 and Y is 164; X is 55 and Y is 165; X is 55 and Y is 166; X is 55 and Y is 167; X is 55 and Y is 168; X is 55 and Y is 169; X is 55 and Y is 170; X is 55 and Y is 171; X is 55 and Y is 172; X is 55 and Y is 173; X is 55 and Y is 174; X is 55 and Y is 175; X is 55 and Y is 176; X is 55 and Y is 177; X is 55 and Y is 178; X is 55 and Y is 179; X is 55 and Y is 180; X is 55 and Y is 181; X is 55 and Y is 182; X is 55 and Y is 183; X is 55 and Y is 184; X is 55 and Y is 185; X is 55 and Y is 186;

X is 56 and Y is 1; X is 56 and Y is 2; X is 56 and Y is 3; X is 56 and Y is 4; X is 56 and Y is 5; X is 56 and Y is 6; X is 56 and Y is 7; X is 56 and Y is 8; X is 56 and Y is 9; X is 56 and Y is 10; X is 56 and Y is 11; X is 56 and Y is 12; X is 56 and Y is 13; X is 56 and y is 14; X is 56 and Y is 15; X is 56 and Y is 16; X is 56 and Y is 17; X is 56 and Y is 18; X is 56 and Y is 19; X is 56 and Y is 20; X is 56 and Y is 21; X is 56 and Y is 22; X is 56 and Y is 23; X is 56 and Y is 24; X is 56 and Y is 25; X is 56 and Y is 26; X is 56 and Y is 27; is 56 and Y is 28; X is 56 and Y is 29; X is 56 and Y is 30; X is 56 and Y is 31; X is 56 and Y is 32; X is 56 and Y is 33; X is 56 and Y is 34; X is 56 and Y is 35; X is 56 and Y is 36; X is 56 and Y is 37; X is 56 and Y is 38; X is 56 and Y is 39; X is 56 and Y is 40; X is 56 and Y is 41; X is 56 and Y is 42; X is 56 and Y is 43; X is 56 and Y is 44; X is 56 and Y is 45; X is 56 and Y is 46; X is 56 and Y is 47; X is 56 and Y is 48; X is 56 and Y is 49; X is 56 and Y is 50; X is 56 and Y is 51; X is 56 and Y is 52; X is 56 and Y is 53; X is 56 and Y is 54; X is 56 and Y is 55; X is 56 and Y is 56; X is 56 and Y is 57; X is 56 and Y is 58; X is 56 and Y is 59; X is 56 and Y is 60; X is 56 and Y is 61; X is 56 and Y is 62; X is 56 and Y is 63; X is 56 and Y is 64; X is 56 and Y is 65; X is 56 and Y is 66; X is 56 and Y is 67; X is 56 and Y is 68; X is 56 and Y is 69; X is 56 and Y is 70; X is 56 and Y is 71; X is 56 and Y is 72; X is 56 and Y is 73; X is 56 and Y is 74; X is 56 and Y is 75; X is 56 and Y is 76; X is 56 and Y is 77; X is 56 and Y is 78; X is 56 and Y is 79; X is 56 and Y is 80; X is 56 and Y is 81; X is 56 and Y is 82; X is 56 and Y is 83; X is 56 and Y is 84; X is 56 and Y is 85; X is 56 and Y is 86; X is 56 and Y is 87; X is 56 and Y is 88; X is 56 and Y is 89; X is 56 and Y is 90; X is 56 and Y is 91; X is 56 and Y is 92; X is 56 and Y is 93; X is 56 and Y is 94; X is 56 and Y is 95; X is 56 and Y is 96; X is 56 and Y is 97; X is 56 and Y is 98; X is 56 and Y is 99; X is 56 and Y is 100; X is 56 and Y is 101; X is 56 and Y is 102; X is 56 and Y is 103; X is 56 and Y is 104; X is 56 and Y is 105; X is 56 and Y is 106; X is 56 and Y is 107; X is 56 and Y is 108; X is 56 and Y is 109; X is 56 and Y is 110; X is 56 and Y is 111; X is 56 and Y is 112; X is 56 and Y is 113; X is 56 and Y is 114; X is 56 and Y is 115; X is 56 and Y is 116; X is 56 and Y is 117; X is 56 and Y is 118; X is 56 and Y is 119; X is 56 and Y is 120; X is 56 and Y is 121; X is 56 and Y is 122; X is 56 and Y is 123; X is 56 and Y is 124; X is 56 and Y is 125; X is 56 and Y is 126; X is 56 and Y is 127; X is 56 and Y is 128; X is 56 and Y is 129; X is 56 and Y is 130; X is 56 and Y is 131; X is 56 and Y is 132; X is 56 and Y is 133; X is 56 and Y is 134; X is 56 and Y is 135; X is 56 and Y is 136; X is 56 and Y is 137; X is 56 and Y is 138; X is 56 and Y is 139; X is 56 and Y is 140; X is 56 and Y is 141; X is 56 and Y is 142; X is 56 and Y is 143; X is 56 and Y is 144; X is 56 and Y is 145; X is 56 and Y is 146; X is 56 and Y is 147; X is 56 and Y is 148; X is 56 and Y is 149; is 56 and Y is 150; is 56 and Y is 151; X is 56 and Y is 152; X is 56 and Y is 153; X is 56 and Y is 154; X is 56 and Y is 155; X is 56 and Y is 156; X is 56 and Y is 157; X is 56 and Y is 158; X is 56 and Y is 159; X is 56 and Y is 160; X is 56 and Y is 161; X is 56 and Y is 162; X is 56 and Y is 163; X is 56 and Y is 164; X is 56 and Y is 165; X is 56 and Y is 166; X is 56 and Y is 167; X is 56 and Y is 168; X is 56 and Y is 169; X is 56 and Y is 170; X is 56 and Y is 171; X is 56 and Y is 172; X is 56 and Y is 173; X is 56 and Y is 174; X is 56 and Y is 175; X is 56 and Y is 176; X is 56 and Y is 177; X is 56 and Y is 178; X is 56 and Y is 179; X is 56 and Y is 180; X is 56 and Y is 181; X is 56 and Y is 182; X is 56 and Y is 183; X is 56 and Y is 184; X is 56 and Y is 185; X is 56 and Y is 186;

X is 57 and Y is 1; X is 57 and Y is 2; X is 57 and Y is 3; X is 57 and Y is 4; X is 57 and Y is 5; X is 57 and Y is 6; X is 57 and Y is 7; X is 57 and Y is 8; X is 57 and Y is 9; X is 57 and Y is 10; X is 57 and Y is 11; X is 57 and Y is 12; X is 57 and Y is 13; X is 57 and Y is 14; X is 57 and Y is 15; X is 57 and Y is 16; X is 57 and Y is 17; X is 57 and Y is 18; X is 57 and Y is 19; X is 57 and Y is 20; X is 57 and Y is 21; X is 57 and Y is 22; X is 57 and Y is 23; X is 57 and Y is 24; X is 57 and Y is 25; X is 57 and Y is 26; X is 57 and Y is 27; X is 57 and Y is 28; X is 57 and Y is 29; X is 57 and Y is 30; X is 57 and Y is 31; X is 57 and Y is 32; X is 57 and Y is 33; X is 57 and Y is 34; X is 57 and Y is 35; X is 57 and Y is 36; X is 57 and Y is 37; X is 57 and Y is 38; X is 57 and Y is 39; X is 57 and Y is 40; X is 57 and Y is 41; X is 57 and Y is 42; X is 57 and Y is 43; X is 57 and Y is 44; X is 57 and Y is 45; X is 57 and Y is 46; X is 57 and Y is 47; X is 57 and Y is 48; X is 57 and Y is 49; X is 57 and Y is 50; X is 57 and Y is 51; X is 57 and Y is 52; X is 57 and Y is 53; X is 57 and Y is 54; X is 57 and Y is 55; X is 57 and Y is 56; X is 57 and Y is 57; X is 57 and Y is 58; X is 57 and Y is 59; X is 57 and Y is 60; X is 57 and Y is 61; X is 57 and Y is 62; X is 57 and Y is 63; X is 57 and Y is 64; X is 57 and Y is 65; X is 57 and Y is 66; X is 57 and Y is 67; X is 57 and Y is 68; X is 57 and Y is 69; X is 57 and Y is 70; X is 57 and Y is 71; X is 57 and Y is 72; X is 57 and Y is 73; X is 57 and Y is 74; X is 57 and Y is 75; X is 57 and Y is 76; X is 57 and Y is 77; X is 57 and Y is 78; X is 57 and Y is 79; X is 57 and Y is 80; X is 57 and Y is 81; X is 57 and Y is 82; X is 57 and Y is 83; X is 57 and Y is 84; X is 57 and Y is 85; X is 57 and Y is 86; X is 57 and Y is 87; X is 57 and Y is 88; X is 57 and Y is 89; X is 57 and Y is 90; X is 57 and Y is 91; X is 57 and Y is 92; X is 57 and Y is 93; X is 57 and Y is 94; X is 57 and Y is 95; X is 57 and Y is 96; X is 57 and Y is 97; X is 57 and Y is 98; X is 57 and Y is 99; X is 57 and Y is 100; X is 57 and Y is 101; X is 57 and Y is 102; X is 57 and Y is 103; X is 57 and Y is 104; X is 57 and Y is 105; X is 57 and Y is 106; X is 57 and Y is 107; X is 57 and Y is 108; X is 57 and Y is 109; X is 57 and Y is 110; X is 57 and Y is 111; X is 57 and Y is 112; X is 57 and Y is 113; X is 57 and Y is 114; X is 57 and Y is 115; X is 57 and Y is 116; X is 57 and Y is 117; X is 57 and Y is 118; X is 57 and Y is 119; X is 57 and Y is 120; X is 57 and Y is 121; X is 57 and Y is 122; X is 57 and Y is 123; X is 57 and Y is 124; X is 57 and Y is 125; X is 57 and Y is 126; X is 57 and Y is 127; X is 57 and Y is 128; X is 57 and Y is 129; X is 57 and Y is 130; X is 57 and Y is 131; X is 57 and Y is 132; X is 57 and Y is 133; X is 57 and Y is 134; X is 57 and Y is 135; X is 57 and Y is 136; X is 57 and Y is 137; X is 57 and Y is 138; X is 57 and Y is 139; X is 57 and Y is 140; X is 57 and Y is 141; X is 57 and Y is 142; X is 57 and Y is 143; X is 57 and Y is 144; X is 57 and Y is 145; X is 57 and Y is 146; X is 57 and Y is 147; X is 57 and Y is 148; X is 57 and Y is 149; X is 57 and Y is 150; X is 57 and Y is 151; X is 57 and Y is 152; X is 57 and Y is 153; X is 57 and Y is 154; X is 57 and Y is 155; X is 57 and Y is 156; X is 57 and Y is 157; X is 57 and Y is 158; X is 57 and Y is 159; X is 57 and Y is 160; X is 57 and Y is 161; X is 57 and Y is 162; X is 57 and Y is 163; X is 57 and Y is 164; X is 57 and Y is 165; X is 57 and Y is 166; X is 57 and Y is 167; X is 57 and Y is 168; X is 57 and Y is 169; X is 57 and Y is 170; X is 57 and Y is 171; X is 57 and Y is 172; X is 57 and Y is 173; X is 57 and Y is 174; X is 57 and Y is 175; X is 57 and Y is 176; X is 57 and Y is 177; X is 57 and Y is 178; X is 57 and Y is 179; X is 57 and Y is 180; X is 57 and Y is 181; X is 57 and Y is 182; X is 57 and Y is 183; X is 57 and Y is 184; X is 57 and Y is 185; X is 57 and Y is 186; X is 58 and Y is 1; X is 58 and Y is 2; X is 58 and Y is 3; X is 58 and Y is 4; X is 58 and Y is 5; X is 58 and Y is 6; X is 58 and Y is 7; X is 58 and Y is 8; X is 58 and Y is 9; X is 58 and Y is 10; X is 58 and Y is 11; X is 58 and Y is 12; X is 58 and Y is 13; X is 58 and Y is 14; X is 58 and Y is 15; X is 58 and Y is 16; X is 58 and Y is 17; X is 58 and Y is 18; X is 58 and Y is 19; X is 58 and Y is 20; X is 58 and Y is 21; X is 58 and Y is 22; X is 58 and Y is 23; X is 58 and Y is 24; X is 58 and Y is 25; X is 58 and Y is 26; X is 58 and Y is 27; X is 58 and Y is 28; X is 58 and Y is 29; X is 58 and Y is 30; X is 58 and Y is 31; X is 58 and Y is 32; X is 58 and Y is 33; X is 58 and Y is 34; X is 58 and Y is 35; X is 58 and Y is 36; X is 58 and Y is 37; X is 58 and Y is 38; X is 58 and Y is 39; X is 58 and Y is 40; X is 58 and Y is 41; X is 58 and Y is 42; X is 58 and Y is 43; X is 58 and Y is 44; X is 58 and Y is 45; X is 58 and Y is 46; X is 58 and Y is 47; X is 58 and Y is 48; X is 58 and Y is 49; X is 58 and Y is 50; X is 58 and Y is 51; X is 58 and Y is 52; X is 58 and Y is 53; X is 58 and Y is 54; X is 58 and Y is 55; X is 58 and Y is 56; X is 58 and Y is 57; X is 58 and Y is 58; X is 58 and Y is 59; X is 58 and Y is 60; X is 58 and Y is 61; X is 58 and Y is 62; X is 58 and Y is 63; X is 58 and Y is 64; X is 58 and Y is 65; X is 58 and Y is 66; X is 58 and Y is 67; X is 58 and Y is 68; X is 58 and Y is 69; X is 58 and Y is 70; X is 58 and Y is 71; X is 58 and Y is 72; X is 58 and Y is 73; X is 58 and Y is 74; X is 58 and Y is 75; X is 58 and Y is 76; X is 58 and Y is 77; X is 58 and Y is 78; X is 58 and Y is 79; X is 58 and Y is 80; X is 58 and Y is 81; X is 58 and Y is 82; X is 58 and Y is 83; X is 58 and Y is 84; X is 58 and Y is 85; X is 58 and Y is 86; X is 58 and Y is 87; X is 58 and Y is 88; X is 58 and Y is 89; X is 58 and Y is 90; X is 58 and Y is 91; X is 58 and Y is 92; X is 58 and Y is 93; X is 58 and Y is 94; X is 58 and Y is 95; X is 58 and Y is 96; X is 58 and Y is 97; X is 58 and Y is 98; X is 58 and Y is 99; X is 58 and Y is 100; X is 58 and Y is 101; X is 58 and Y is 102; X is 58 and Y is 103; X is 58 and Y is 104; X is 58 and Y is 105; X is 58 and Y is 106; X is 58 and Y is 107; X is 58 and Y is 108; X is 58 and Y is 109; X is 58 and Y is 110; X is 58 and Y is 111; X is 58 and Y is 112; X is 58 and Y is 113; X is 58 and Y is 114; X is 58 and Y is 115; X is 58 and Y is 116; X is 58 and Y is 117; X is 58 and Y is 118; X is 58 and Y is 119; X is 58 and Y is 120; X is 58 and Y is 121; X is 58 and Y is 122; X is 58 and Y is 123; X is 58 and Y is 124; X is 58 and Y is 125; X is 58 and Y is 126; X is 58 and Y is 127; X is 58 and Y is 128; X is 58 and Y is 129; X is 58 and Y is 130; X is 58 and Y is 131; X is 58 and Y is 132; X is 58 and Y is 133; X is 58 and Y is 134; X is 58 and Y is 135; X is 58 and Y is 136; X is 58 and Y is 137; X is 58 and Y is 138; X is 58 and Y is 139; X is 58 and Y is 140; X is 58 and Y is 141; X is 58 and Y is 142; X is 58 and Y is 143; X is 58 and Y is 144; X is 58 and Y is 145; X is 58 and Y is 146; X is 58 and Y is 147; X is 58 and Y is 148; X is 58 and Y is 149; X is 58 and Y is 150; X is 58 and Y is 151; X is 58 and Y is 152; X is 58 and Y is 153; X is 58 and Y is 154; X is 58 and Y is 155; X is 58 and Y is 156; X is 58 and Y is 157; X is 58 and Y is 158; X is 58 and Y is 159; X is 58 and Y is 160; X is 58 and Y is 161; X is 58 and Y is 162; X is 58 and Y is 163; X is 58 and Y is 164; X is 58 and Y is 165; X is 58 and Y is 166; X is 58 and Y is 167; X is 58 and Y is 168; X is 58 and Y is 169; X is 58 and Y is 170; X is 58 and Y is 171; X is 58 and Y is 172; X is 58 and Y is 173; X is 58 and Y is 174; X is 58 and Y is 175; X is 58 and Y is 176; X is 58 and Y is 177; X is 58 and Y is 178; X is 58 and Y is 179; X is 58 and Y is 180; X is 58 and Y is 181; X is 58 and Y is 182; X is 58 and Y is 183; X is 58 and Y is 184; X is 58 and Y is 185; X is 58 and Y is 186; X is 59 and Y is 1; X is 59 and Y is 2; X is 59 and Y is 3; X is 59 and Y is 4; X is 59 and Y is 5; X is 59 and Y is 6; X is 59 and Y is 7; X is 59 and Y is 8; X is 59 and Y is 9; X is 59 and Y is 10; X is 59 and Y is 11; X is 59 and Y is 12; X is 59 and Y is 13; X is 59 and Y is 14; X is 59 and Y is 15; X is 59 and Y is 16; X is 59 and Y is 17; X is 59 and Y is 18; X is 59 and Y is 19; X is 59 and Y is 20; X is 59 and Y is 21; X is 59 and Y is 22; X is 59 and Y is 23; X is 59 and Y is 24; X is 59 and Y is 25; X is 59 and Y is 26; X is 59 and Y is 27; X is 59 and Y is 28; X is 59 and Y is 29; X is 59 and Y is 30; X is 59 and Y is 31; X is 59 and Y is 32; X is 59 and Y is 33; X is 59 and Y is 34; X is 59 and Y is 35; X is 59 and Y is 36; X is 59 and Y is 37; X is 59 and Y is 38; X is 59 and Y is 39; X is 59 and Y is 40; X is 59 and Y is 41; X is 59 and Y is 42; X is 59 and Y is 43; X is 59 and Y is 44; X is 59 and Y is 45; X is 59 and Y is 46; X is 59 and Y is 47; X is 59 and Y is 48; X is 59 and Y is 49; X is 59 and Y is 50; X is 59 and Y is 51; X is 59 and Y is 52; X is 59 and Y is 53; X is 59 and Y is 54; X is 59 and Y is 55; X is 59 and Y is 56; X is 59 and Y is 57; X is 59 and Y is 58; X is 59 and Y is 59; X is 59 and Y is 60; X is 59 and Y is 61; X is 59 and Y is 62; X is 59 and Y is 63; X is 59 and Y is 64; X is 59 and Y is 65; X is 59 and Y is 66; X is 59 and Y is 67; X is 59 and Y is 68; X is 59 and Y is 69; X is 59 and Y is 70; X is 59 and Y is 71; X is 59 and Y is 72; X is 59 and Y is 73; X is 59 and Y is 74; X is 59 and Y is 75; X is 59 and Y is 76; X is 59 and Y is 77; X is 59 and Y is 78; X is 59 and Y is 79; X is 59 and Y is 80; X is 59 and Y is 81; X is 59 and Y is 82; X is 59 and Y is 83; X is 59 and Y is 84; X is 59 and Y is 85; X is 59 and Y is 86; X is 59 and Y is 87; X is 59 and Y is 88; X is 59 and Y is 89; X is 59 and Y is 90; X is 59 and Y is 91; X is 59 and Y is 92; X is 59 and Y is 93; X is 59 and Y is 94; X is 59 and Y is 95; X is 59 and Y is 96; X is 59 and Y is 97; X is 59 and Y is 98; X is 59 and Y is 99; X is 59 and Y is 100; X is 59 and Y is 101; X is 59 and Y is 102; X is 59 and Y is 103; X is 59 and Y is 104; X is 59 and Y is 105; X is 59 and Y is 106; X is 59 and Y is 107; X is 59 and Y is 108; X is 59 and Y is 109; X is 59 and Y is 110; X is 59 and Y is 111; X is 59 and Y is 112; X is 59 and Y is 113; X is 59 and Y is 114; X is 59 and Y is 115; X is 59 and Y is 116; X is 59 and Y is 117; X is 59 and Y is 118; X is 59 and Y is 119; X is 59 and Y is 120; X is 59 and Y is 121; X is 59 and Y is 122; X is 59 and Y is 123; X is 59 and Y is 124; X is 59 and Y is 125; X is 59 and Y is 126; X is 59 and Y is 127; X is 59 and Y is 128; X is 59 and Y is 129; X is 59 and Y is 130; X is 59 and Y is 131; X is 59 and Y is 132; X is 59 and Y is 133; X is 59 and Y is 134; X is 59 and Y is 135; X is 59 and Y is 136; X is 59 and Y is 137; X is 59 and Y is 138; X is 59 and Y is 139; X is 59 and Y is 140; X is 59 and Y is 141; X is 59 and Y is 142; X is 59 and Y is 143; X is 59 and Y is 144; X is 59 and Y is 145; X is 59 and Y is 146; X is 59 and Y is 147; X is 59 and Y is 148; X is 59 and Y is 149; X is 59 and Y is 150; X is 59 and Y is 151; X is 59 and Y is 152; X is 59 and Y is 153; X is 59 and Y is 154; X is 59 and Y is 155; X is 59 and Y is 156; X is 59 and Y is 157; X is 59 and Y is 158; X is 59 and Y is 159; X is 59 and Y is 160; X is 59 and Y is 161; X is 59 and Y is 162; X is 59 and Y is 163; X is 59 and Y is 164; X is 59 and Y is 165; X is 59 and Y is 166; X is 59 and Y is 167; X is 59 and Y is 168; X is 59 and Y is 169; X is 59 and Y is 170; X is 59 and Y is 171; X is 59 and Y is 172; X is 59 and Y is 173; X is 59 and Y is 174; X is 59 and Y is 175; X is 59 and Y is 176; X is 59 and Y is 177; X is 59 and Y is 178; X is 59 and Y is 179; X is 59 and Y is 180; X is 59 and Y is 181; X is 59 and Y is 182; X is 59 and Y is 183; X is 59 and Y is 184; X is 59 and Y is 185; X is 59 and Y is 186; X is 60 and Y is 1; X is 60 and Y is 2; X is 60 and Y is 3; X is 60 and Y is 4; X is 60 and Y is 5; X is 60 and Y is 6; X is 60 and Y is 7; X is 60 and Y is 8; X is 60 and Y is 9; X is 60 and Y is 10; X is 60 and Y is 11; X is 60 and Y is 12; X is 60 and Y is 13; X is 60 and Y is 14; X is 60 and Y is 15; X is 60 and Y is 16; X is 60 and Y is 17; X is 60 and Y is 18; X is 60 and Y is 19; X is 60 and Y is 20; X is 60 and Y is 21; X is 60 and Y is 22; X is 60 and Y is 23; X is 60 and Y is 24; X is 60 and Y is 25; X is 60 and Y is 26; X is 60 and Y is 27; X is 60 and Y is 28; X is 60 and Y is 29; X is 60 and Y is 30; X is 60 and Y is 31; X is 60 and Y is 32; X is 60 and Y is 33; X is 60 and Y is 34; X is 60 and Y is 35; X is 60 and Y is 36; X is 60 and Y is 37; X is 60 and Y is 38; X is 60 and Y is 39; X is 60 and Y is 40; X is 60 and Y is 41; X is 60 and Y is 42; X is 60 and Y is 43; X is 60 and Y is 44; X is 60 and Y is 45; X is 60 and Y is 46; X is 60 and Y is 47; X is 60 and Y is 48; X is 60 and Y is 49; X is 60 and Y is 50; X is 60 and Y is 51; X is 60 and Y is 52; X is 60 and Y is 53; X is 60 and Y is 54; X is 60 and Y is 55; X is 60 and Y is 56; X is 60 and Y is 57; X is 60 and Y is 58; X is 60 and Y is 59; X is 60 and Y is 60; X is 60 and Y is 61; X is 60 and Y is 62; X is 60 and Y is 63; X is 60 and Y is 64; X is 60 and Y is 65; X is 60 and Y is 66; X is 60 and Y is 67; X is 60 and Y is 68; X is 60 and Y is 69; X is 60 and Y is 70; X is 60 and Y is 71; X is 60 and Y is 72; X is 60 and Y is 73; X is 60 and Y is 74; X is 60 and Y is 75; X is 60 and Y is 76; X is 60 and Y is 77; X is 60 and Y is 78; X is 60 and Y is 79; X is 60 and Y is 80; X is 60 and Y is 81; X is 60 and Y is 82; X is 60 and Y is 83; X is 60 and Y is 84; X is 60 and Y is 85; X is 60 and Y is 86; X is 60 and Y is 87; X is 60 and Y is 88; X is 60 and Y is 89; X is 60 and Y is 90; X is 60 and Y is 91; X is 60 and Y is 92; X is 60 and Y is 93; X is 60 and Y is 94; X is 60 and Y is 95; X is 60 and Y is 96; X is 60 and Y is 97; X is 60 and Y is 98; X is 60 and Y is 99; X is 60 and Y is 100; X is 60 and Y is 101; X is 60 and Y is 102; X is 60 and Y is 103; X is 60 and Y is 104; X is 60 and Y is 105; X is 60 and Y is 106; X is 60 and Y is 107; X is 60 and Y is 108; X is 60 and Y is 109; X is 60 and Y is 110; X is 60 and Y is 111; X is 60 and Y is 112; X is 60 and Y is 113; X is 60 and Y is 114; X is 60 and Y is 115; X is 60 and Y is 116; X is 60 and Y is 117; X is 60 and Y is 118; X is 60 and Y is 119; X is 60 and Y is 120; X is 60 and Y is 121; X is 60 and Y is 122; X is 60 and Y is 123; X is 60 and Y is 124; X is 60 and Y is 125; X is 60 and Y is 126; X is 60 and Y is 127; X is 60 and Y is 128; X is 60 and Y is 129; X is 60 and Y is 130; X is 60 and Y is 131; X is 60 and Y is 132; X is 60 and Y is 133; X is 60 and Y is 134; X is 60 and Y is 135; X is 60 and Y is 136; X is 60 and Y is 137; X is 60 and Y is 138; X is 60 and Y is 139; X is 60 and Y is 140; X is 60 and Y is 141; X is 60 and Y is 142; X is 60 and Y is 143; X is 60 and Y is 144; X is 60 and Y is 145; X is 60 and Y is 146; X is 60 and Y is 147; X is 60 and Y is 148; X is 60 and Y is 149; X is 60 and Y is 150; X is 60 and Y is 151; X is 60 and Y is 152; X is 60 and Y is 153; X is 60 and Y is 154; X is 60 and Y is 155; X is 60 and Y is 156; X is 60 and Y is 157; X is 60 and Y is 158; X is 60 and Y is 159; X is 60 and Y is 160; X is 60 and Y is 161; X is 60 and Y is 162; X is 60 and Y is 163; X is 60 and Y is 164; X is 60 and Y is 165; X is 60 and Y is 166; X is 60 and Y is 167; X is 60 and Y is 168; X is 60 and Y is 169; X is 60 and Y is 170; X is 60 and Y is 171; X is 60 and Y is 172; X is 60 and Y is 173; X is 60 and Y is 174; X is 60 and Y is 175; X is 60 and Y is 176; X is 60 and Y is 177; X is 60 and Y is 178; X is 60 and Y is 179; X is 60 and Y is 180; X is 60 and Y is 181; X is 60 and Y is 182; X is 60 and Y is 183; X is 60 and Y is 184; X is 60 and Y is 185; X is 60 and Y is 186; X is 61 and Y is 1; X is 61 and Y is 2; X is 61 and Y is 3; X is 61 and Y is 4; X is 61 and Y is 5; X is 61 and Y is 6; X is 61 and Y is 7; X is 61 and Y is 8; X is 61 and Y is 9; X is 61 and Y is 10; X is 61 and Y is 11; X is 61 and Y is 12; X is 61 and Y is 13; X is 61 and Y is 14; X is 61 and Y is 15; X is 61 and Y is 16; X is 61 and Y is 17; X is 61 and Y is 18; X is 61 and Y is 19; X is 61 and Y is 20; X is 61 and Y is 21; X is 61 and Y is 22; X is 61 and Y is 23; X is 61 and Y is 24; X is 61 and Y is 25; X is 61 and Y is 26; X is 61 and Y is 27; X is 61 and Y is 28; X is 61 and Y is 29; X is 61 and Y is 30; X is 61 and Y is 31; X is 61 and Y is 32; X is 61 and Y is 33; X is 61 and Y is 34; X is 61 and Y is 35; X is 61 and Y is 36; X is 61 and Y is 37; X is 61 and Y is 38; X is 61 and Y is 39; X is 61 and Y is 40; X is 61 and Y is 41; X is 61 and Y is 42; X is 61 and Y is 43; X is 61 and Y is 44; X is 61 and Y is 45; X is 61 and Y is 46; X is 61 and Y is 47; X is 61 and Y is 48; X is 61 and Y is 49; X is 61 and Y is 50; X is 61 and Y is 51; X is 61 and Y is 52; X is 61 and Y is 53; X is 61 and Y is 54; X is 61 and Y is 55; X is 61 and Y is 56; X is 61 and Y is 57; X is 61 and Y is 58; X is 61 and Y is 59; X is 61 and Y is 60; X is 61 and Y is 61; X is 61 and Y is 62; X is 61 and Y is 63; X is 61 and Y is 64; X is 61 and Y is 65; X is 61 and Y is 66; X is 61 and Y is 67; X is 61 and Y is 68; X is 61 and Y is 69; X is 61 and Y is 70; X is 61 and Y is 71; X is 61 and Y is 72; X is 61 and Y is 73; X is 61 and Y is 74; X is 61 and Y is 75; X is 61 and Y is 76; X is 61 and Y is 77; X is 61 and Y is 78; X is 61 and Y is 79; X is 61 and Y is 80; X is 61 and Y is 81; X is 61 and Y is 82; X is 61 and Y is 83; X is 61 and Y is 84; X is 61 and Y is 85; X is 61 and Y is 86; X is 61 and Y is 87; X is 61 and Y is 88; X is 61 and Y is 89; X is 61 and Y is 90; X is 61 and Y is 91; X is 61 and Y is 92; X is 61 and Y is 93; X is 61 and Y is 94; X is 61 and Y is 95; X is 61 and Y is 96; X is 61 and Y is 97; X is 61 and Y is 98; X is 61 and Y is 99; X is 61 and Y is 100; X is 61 and Y is 101; X is 61 and Y is 102; X is 61 and Y is 103; X is 61 and Y is 104; X is 61 and Y is 105; X is 61 and Y is 106; X is 61 and Y is 107; X is 61 and Y is 108; X is 61 and Y is 109; X is 61 and Y is 110; X is 61 and Y is 111; X is 61 and Y is 112; X is 61 and Y is 113; X is 61 and Y is 114; X is 61 and Y is 115; X is 61 and Y is 116; X is 61 and Y is 117; X is 61 and Y is 118; X is 61 and Y is 119; X is 61 and Y is 120; X is 61 and Y is 121; X is 61 and Y is 122; X is 61 and Y is 123; X is 61 and Y is 124; X is 61 and Y is 125; X is 61 and Y is 126; X is 61 and Y is 127; X is 61 and Y is 128; X is 61 and Y is 129; X is 61 and Y is 130; X is 61 and Y is 131; X is 61 and Y is 132; X is 61 and Y is 133; X is 61 and Y is 134; X is 61 and Y is 135; X is 61 and Y is 136; X is 61 and Y is 137; X is 61 and Y is 138; X is 61 and Y is 139; X is 61 and Y is 140; X is 61 and Y is 141; X is 61 and Y is 142; X is 61 and Y is 143; X is 61 and Y is 144; X is 61 and Y is 145; X is 61 and Y is 146; X is 61 and Y is 147; X is 61 and Y is 148; X is 61 and Y is 149; X is 61 and Y is 150; X is 61 and Y is 151; X is 61 and Y is 152; X is 61 and Y is 153; X is 61 and Y is 154; X is 61 and Y is 155; X is 61 and Y is 156; X is 61 and Y is 157; X is 61 and Y is 158; X is 61 and Y is 159; X is 61 and Y is 160; X is 61 and Y is 161; X is 61 and Y is 162; X is 61 and Y is 163; X is 61 and Y is 164; X is 61 and Y is 165; X is 61 and Y is 166; X is 61 and Y is 167; X is 61 and Y is 168; X is 61 and Y is 169; X is 61 and Y is 170; X is 61 and Y is 171; X is 61 and Y is 172; X is 61 and Y is 171; X is 61 and Y is 174; X is 61 and Y is 175; X is 61 and Y is 176; X is 61 and Y is 177; X is 61 and Y is 178; X is 61 and Y is 179; X is 61 and Y is 180; X is 61 and Y is 181; X is 61 and Y is 182; X is 61 and Y is 183; X is 61 and Y is 184; X is 61 and Y is 185; X is 61 and Y is 186;

X is 62 and Y is 1; X is 62 and Y is 2; X is 62 and Y is 3; X is 62 and Y is 4; X is 62 and Y is 5; X is 62 and Y is 6; X is 62 and Y is 7; X is 62 and Y is 8; X is 62 and Y is 9; X is 62 and Y is 10; X is 62 and Y is 11; X is 62 and Y is 12; X is 62 and Y is 13; X is 62 and Y is 14; X is 62 and Y is 15; X is 62 and Y is 16; X is 62 and Y is 17; X is 62 and Y is 18; X is 62 and Y is 19; X is 62 and Y is 20; X is 62 and Y is 21; X is 62 and Y is 22; X is 62 and Y is 23; X is 62 and Y is 24; X is 62 and Y is 25; X is 62 and Y is 26; X is 62 and Y is 27; X is 62 and Y is 28; X is 62 and Y is 29; X is 62 and Y is 30; X is 62 and Y is 31; X is 62 and Y is 32; X is 62 and Y is 33; X is 62 and Y is 34; X is 62 and Y is 35; X is 62 and Y is 36; X is 62 and Y is 37; X is 62 and Y is 38; X is 62 and Y is 39; X is 62 and Y is 40; X is 62 and Y is 41; X is 62 and Y is 42; X is 62 and Y is 43; X is 62 and Y is 44; X is 62 and Y is 45; X is 62 and Y is 46; X is 62 and Y is 47; X is 62 and Y is 48; X is 62 and Y is 49; X is 62 and Y is 50; X is 62 and Y is 51; X is 62 and Y is 52; X is 62 and Y is 53; X is 62 and Y is 54; X is 62 and Y is 55; X is 62 and Y is 56; X is 62 and Y is 57; X is 62 and Y is 58; X is 62 and Y is 59; X is 62 and Y is 60; X is 62 and Y is 61; X is 62 and Y is 62; X is 62 and Y is 63; X is 62 and Y is 64; X is 62 and Y is 65; X is 62 and Y is 66; X is 62 and Y is 67; X is 62 and Y is 68; X is 62 and Y is 69; X is 62 and Y is 70; X is 62 and Y is 71; X is 62 and Y is 72; X is 62 and Y is 73; X is 62 and Y is 74; X is 62 and Y is 75; X is 62 and Y is 76; X is 62 and Y is 77; X is 62 and Y is 78; X is 62 and Y is 79; X is 62 and Y is 80; X is 62 and Y is 81; X is 62 and Y is 82; X is 62 and Y is 83; X is 62 and Y is 84; X is 62 and Y is 85; X is 62 and Y is 86; X is 62 and Y is 87; X is 62 and Y is 88; X is 62 and Y is 89; X is 62 and Y is 90; X is 62 and Y is 91; X is 62 and Y is 92; X is 62 and Y is 93; X is 62 and Y is 94; X is 62 and Y is 95; X is 62 and Y is 96; X is 62 and Y is 97; X is 62 and Y is 98; X is 62 and Y is 99; X is 62 and Y is 100; X is 62 and Y is 101; X is 62 and Y is 102; X is 62 and Y is 103; X is 62 and Y is 104; X is 62 and Y is 105; X is 62 and Y is 106; X is 62 and Y is 107; X is 62 and Y is 108; X is 62 and Y is 109; X is 62 and Y is 110; X is 62 and Y is 111; X is 62 and Y is 112; X is 62 and Y is 113; X is 62 and Y is 114; X is 62 and Y is 115; X is 62 and Y is 116; X is 62 and Y is 117; X is 62 and Y is 118; X is 62 and Y is 119; X is 62 and Y is 120; X is 62 and Y is 121; X is 62 and Y is 122; X is 62 and Y is 123; X is 62 and Y is 124; X is 62 and Y is 125; X is 62 and Y is 126; X is 62 and Y is 127; X is 62 and Y is 128; X is 62 and Y is 129; X is 62 and Y is 130; X is 62 and Y is 131; X is 62 and Y is 132; X is 62 and Y is 133; X is 62 and Y is 134; X is 62 and Y is 135; X is 62 and Y is 136; X is 62 and Y is 137; X is 62 and Y is 138; X is 62 and Y is 139; X is 62 and Y is 140; X is 62 and Y is 141; X is 62 and Y is 142; X is 62 and Y is 143; X is 62 and Y is 144; is 62 and Y is 145; X is 62 and Y is 146; X is 62 and Y is 147; X is 62 and Y is 148; X is 62 and Y is 149; X is 62 and Y is 150; X is 62 and Y is 151; X is 62 and Y is 152; X is 62 and Y is 153; X is 62 and Y is 154; X is 62 and Y is 155; X is 62 and Y is 156; X is 62 and Y is 157; X is 62 and Y is 158; X is 62 and Y is 159; X is 62 and Y is 160; X is 62 and Y is 161; X is 62 and Y is 162; X is 62 and Y is 163; X is 62 and Y is 164; X is 62 and Y is 165; X is 62 and Y is 166; X is 62 and Y is 167; X is 62 and Y is 168; X is 62 and Y is 169; X is 62 and Y is 170; X is 62 and Y is 171; X is 62 and Y is 172; X is 62 and Y is 173; X is 62 and Y is 174; X is 62 and Y is 175; X is 62 and Y is 176; X is 62 and Y is 177; X is 62 and Y is 178; X is 62 and Y is 179; X is 62 and Y is 180; X is 62 and Y is 181; X is 62 and Y is 182; X is 62 and Y is 183; X is 62 and Y is 184; X is 62 and Y is 185; X is 62 and Y is 186;

X is 63 and Y is 1; X is 63 and Y is 2; X is 63 and Y is 3; X is 63 and Y is 4; X is 63 and Y is 5; X is 63 and Y is 6; X is 63 and Y is 7; X is 63 and Y is 8; X is 63 and Y is 9; X is 63 and Y is 10; X is 63 and Y is 11; X is 63 and Y is 12; X is 63 and Y is 13; X is 63 and Y is 14; X is 63 and Y is 15; X is 63 and Y is 16; X is 63 and Y is 17; X is 63 and Y is 18; X is 63 and Y is 19; X is 63 and Y is 20; X is 63 and Y is 21; X is 63 and Y is 22; X is 63 and Y is 23; X is 63 and Y is 24; X is 63 and Y is 25; X is 63 and Y is 26; X is 63 and Y is 27; X is 63 and Y is 28; X is 63 and Y is 29; X is 63 and Y is 30; X is 63 and Y is 31; X is 63 and Y is 32; X is 63 and Y is 33; X is 63 and Y is 34; X is 63 and Y is 35; X is 63 and Y is 36; X is 63 and Y is 37; X is 63 and Y is 38; X is 63 and Y is 39; X is 63 and Y is 40; X is 63 and Y is 41; X is 63 and Y is 42; X is 63 and Y is 43; X is 63 and Y is 44; X is 63 and Y is 45; X is 63 and Y is 46; X is 63 and Y is 47; X is 63 and Y is 48; X is 63 and Y is 49; X is 63 and Y is 50; X is 63 and Y is 51; X is 63 and Y is 52; X is 63 and Y is 53; X is 63 and Y is 54; X is 63 and Y is 55; X is 63 and Y is 56; X is 63 and Y is 57; X is 63 and Y is 58; X is 63 and Y is 59; X is 63 and Y is 60; X is 63 and Y is 61; X is 63 and Y is 62; X is 63 and Y is 63; X is 63 and Y is 64; X is 63 and Y is 65; X is 63 and Y is 66; X is 63 and Y is 67; X is 63 and Y is 68; X is 63 and Y is 69; X is 63 and Y is 70; X is 63 and Y is 71; X is 63 and Y is 72; X is 63 and Y is 73; X is 63 and Y is 74; X is 63 and Y is 75; X is 63 and Y is 76; X is 63 and Y is 77; X is 63 and Y is 78; X is 63 and Y is 79; X is 63 and Y is 80; X is 63 and Y is 81; X is 63 and Y is 82; X is 63 and Y is 83; X is 63 and Y is 84; X is 63 and Y is 85; X is 63 and Y is 86; X is 63 and Y is 87; X is 63 and Y is 88; X is 63 and Y is 89; X is 63 and Y is 90; X is 63 and Y is 91; X is 63 and Y is 92; X is 63 and Y is 93; X is 63 and Y is 94; X is 63 and Y is 95; X is 63 and Y is 96; X is 63 and Y is 97; X is 63 and Y is 98; X is 63 and Y is 99; X is 63 and Y is 100; X is 63 and Y is 101; X is 63 and Y is 102; X is 63 and Y is 103; X is 63 and Y is 104; X is 63 and Y is 105; X is 63 and Y is 106; X is 63 and Y is 107; X is 63 and Y is 108; X is 63 and Y is 109; X is 63 and Y is 110; X is 63 and Y is 111; X is 63 and Y is 112; X is 63 and Y is 113; X is 63 and Y is 114; X is 63 and Y is 115; X is 63 and Y is 116; X is 63 and Y is 117; X is 63 and Y is 118; X is 63 and Y is 119; X is 63 and Y is 119; X is 63 and Y is 121; X is 63 and Y is 122; X is 63 and Y is 123; X is 63 and Y is 124; X is 63 and Y is 125; X is 63 and Y is 126; X is 63 and Y is 127; X is 63 and Y is 128; X is 63 and Y is 129; X is 63 and Y is 130; X is 63 and Y is 131; X is 63 and Y is 132; X is 63 and Y is 133; X is 63 and Y is 134; X is 63 and Y is 135; X is 63 and Y is 136; X is 63 and Y is 137; X is 63 and Y is 138; X is 63 and Y is 139; X is 63 and Y is 140; X is 63 and Y is 141; X is 63 and Y is 142; X is 63 and Y is 143; X is 63 and Y is 144; X is 63 and Y is 145; X is 63 and Y is 146; X is 63 and Y is 147; X is 63 and Y is 148; X is 63 and Y is 149; X is 63 and Y is 150; X is 63 and Y is 151; X is 63 and Y is 152; X is 63 and Y is 153; X is 63 and Y is 154; X is 63 and Y is 155; X is 63 and Y is 156; X is 63 and Y is 157; X is 63 and Y is 158; X is 63 and Y is 159; X is 63 and Y is 160; X is 63 and Y is 161; X is 63 and Y is 162; X is 63 and Y is 163; X is 63 and Y is 164; X is 63 and Y is 165; X is 63 and Y is 166; X is 63 and Y is 167; X is 63 and Y is 168; X is 63 and Y is 169; X is 63 and Y is 170; X is 63 and Y is 171; X is 63 and Y is 172; X is 63 and Y is 173; X is 63 and Y is 174; X is 63 and Y is 175; X is 63 and Y is 176; X is 63 and Y is 177; X is 63 and Y is 178; X is 63 and Y is 179; X is 63 and Y is 180; X is 63 and Y is 181; X is 63 and Y is 182; X is 63 and Y is 183; X is 63 and Y is 184; X is 63 and Y is 185; is 63 and Y is 186;

X is 64 and Y is 1; X is 64 and Y is 2; X is 64 and Y is 3; X is 64 and Y is 4; X is 64 and Y is 5; X is 64 and Y is 6; X is 64 and Y is 7; X is 64 and Y is 8; X is 64 and Y is 9; X is 64 and Y is 10; X is 64 and Y is 11; X is 64 and Y is 12; X is 64 and Y is 13; X is 64 and Y is 14; X is 64 and Y is 15; X is 64 and Y is 16; X is 64 and Y is 17; X is 64 and Y is 18; X is 64 and Y is 19; X is 64 and Y is 20; X is 64 and Y is 21; X is 64 and Y is 22; X is 64 and Y is 23; X is 64 and Y is 24; X is 64 and Y is 25; X is 64 and Y is 26; X is 64 and Y is 27; X is 64 and Y is 28; X is 64 and Y is 29; X is 64 and Y is 30; X is 64 and Y is 31; X is 64 and Y is 32; X is 64 and Y is 33; X is 64 and Y is 34; X is 64 and Y is 35; X is 64 and Y is 36; X is 64 and Y is 37; X is 64 and Y is 38; X is 64 and Y is 39; X is 64 and Y is 40; X is 64 and Y is 41; X is 64 and Y is 42; X is 64 and Y is 43; X is 64 and Y is 44; X is 64 and Y is 45; X is 64 and Y is 46; X is 64 and Y is 47; X is 64 and Y is 48; X is 64 and Y is 49; X is 64 and Y is 50; X is 64 and Y is 51; X is 64 and Y is 52; X is 64 and Y is 53; X is 64 and Y is 54; X is 64 and Y is 55; X is 64 and Y is 56; X is 64 and Y is 57; X is 64 and Y is 58; X is 64 and Y is 59; X is 64 and Y is 60; X is 64 and Y is 61; X is 64 and Y is 62; X is 64 and Y is 63; X is 64 and Y is 64; X is 64 and Y is 65; X is 64 and Y is 66; X is 64 and Y is 67; X is 64 and Y is 68; X is 64 and Y is 69; X is 64 and Y is 70; X is 64 and Y is 71; X is 64 and Y is 72; X is 64 and Y is 73; X is 64 and Y is 74; X is 64 and Y is 75; X is 64 and Y is 76; X is 64 and Y is 77; X is 64 and Y is 78; X is 64 and Y is 79; X is 64 and Y is 80; X is 64 and Y is 81; X is 64 and Y is 82; X is 64 and Y is 83; X is 64 and Y is 84; X is 64 and Y is 85; X is 64 and Y is 86; X is 64 and Y is 87; X is 64 and Y is 88; X is 64 and Y is 89; X is 64 and Y is 90; X is 64 and Y is 91; X is 64 and is 92; X is 64 and Y is 93; X is 64 and Y is 94; X is 64 and Y is 95; X is 64 and Y is 96; X is 64 and Y is 97; X is 64 and Y is 98; X is 64 and Y is 99; X is 64 and Y is 100; X is 64 and Y is 101; X is 64 and Y is 102; X is 64 and Y is 103; X is 64 and Y is 104; X is 64 and Y is 105; X is 64 and Y is 106; X is 64 and Y is 107; X is 64 and Y is 108; X is 64 and Y is 109; X is 64 and Y is 110; X is 64 and Y is 111; X is 64 and Y is 112; X is 64 and Y is 113; X is 64 and Y is 114; X is 64 and Y is 115; X is 64 and Y is 116; X is 64 and Y is 117; X is 64 and Y is 118; X is 64 and Y is 119; X is 64 and Y is 120; X is 64 and Y is 121; X is 64 and Y is 122; X is 64 and Y is 123; X is 64 and Y is 124; X is 64 and Y is 125; X is 64 and Y is 126; X is 64 and Y is 127; X is 64 and Y is 128; X is 64 and Y is 129; X is 64 and Y is 130; X is 64 and Y is 131; X is 64 and Y is 132; X is 64 and Y is 133; X is 64 and Y is 134; X is 64 and Y is 135; X is 64 and Y is 136; X is 64 and Y is 137; X is 64 and Y is 138; X is 64 and Y is 139; X is 64 and Y is 140; X is 64 and Y is 141; X is 64 and Y is 142; X is 64 and Y is 143; X is 64 and Y is 144; X is 64 and Y is 145; X is 64 and Y is 146; X is 64 and Y is 147; X is 64 and Y is 148; X is 64 and Y is 149; X is 64 and Y is 150; X is 64 and Y is 151; X is 64 and Y is 152; X is 64 and Y is 153; X is 64 and Y is 154; X is 64 and Y is 155; X is 64 and Y is 156; X is 64 and Y is 157; X is 64 and Y is 158; X is 64 and Y is 159; X is 64 and Y is 160; X is 64 and Y is 161; X is 64 and Y is 162; X is 64 and Y is 163; X is 64 and Y is 164; X is 64 and Y is 165; X is 64 and Y is 166; X is 64 and Y is 167; X is 64 and Y is 168; X is 64 and Y is 169; X is 64 and Y is 170; X is 64 and Y is 171; X is 64 and Y is 172; X is 64 and Y is 173; X is 64 and Y is 174; X is 64 and Y is 175; X is 64 and Y is 176; X is 64 and Y is 177; X is 64 and Y is 178; X is 64 and Y is 179; X is 64 and Y is 180; X is 64 and Y is 181; X is 64 and Y is 182; X is 64 and Y is 183; X is 64 and Y is 184; X is 64 and Y is 185; X is 64 and Y is 186;

X is 65 and Y is 1; X is 65 and Y is 2; X is 65 and Y is 3; X is 65 and Y is 4; X is 65 and Y is 5; X is 65 and Y is 6; X is 65 and Y is 7; X is 65 and Y is 8; X is 65 and Y is 9; X is 65 and Y is 10; X is 65 and Y is 11; X is 65 and Y is 12; X is 65 and Y is 13; X is 65 and Y is 14; X is 65 and Y is 15; X is 65 and Y is 16; X is 65 and Y is 17; X is 65 and Y is 18; X is 65 and Y is 19; X is 65 and Y is 20; X is 65 and Y is 21; X is 65 and Y is 22; X is 65 and Y is 23; X is 65 and Y is 24; X is 65 and Y is 25; X is 65 and Y is 26; X is 65 and Y is 27; X is 65 and Y is 28; X is 65 and Y is 29; X is 65 and Y is 30; X is 65 and Y is 31; X is 65 and Y is 32; X is 65 and Y is 33; X is 65 and Y is 34; X is 65 and Y is 35; X is 65 and Y is 36; X is 65 and Y is 37; X is 65 and Y is 38; X is 65 and Y is 39; X is 65 and Y is 40; X is 65 and Y is 41; X is 65 and Y is 42; X is 65 and Y is 43; X is 65 and Y is 44; X is 65 and Y is 45; X is 65 and Y is 46; X is 65 and Y is 47; X is 65 and Y is 48; X is 65 and Y is 49; X is 65 and Y is 50; X is 65 and Y is 51; X is 65 and Y is 52; X is 65 and Y is 53; X is 65 and Y is 54; X is 65 and Y is 55; X is 65 and Y is 56; X is 65 and Y is 57; X is 65 and Y is 58; X is 65 and Y is 59; X is 65 and Y is 60; X is 65 and Y is 61; X is 65 and Y is 62; X is 65 and Y is 63; X is 65 and Y is 64; X is 65 and Y is 65; X is 65 and Y is 66; X is 65 and Y is 67; X is 65 and Y is 68; X is 65 and Y is 69; X is 65 and Y is 70; X is 65 and Y is 71; X is 65 and Y is 72; X is 65 and Y is 73; X is 65 and Y is 74; X is 65 and Y is 75; X is 65 and Y is 76; X is 65 and Y is 77; X is 65 and Y is 78; X is 65 and Y is 79; X is 65 and Y is 80; X is 65 and Y is 81; X is 65 and Y is 82; X is 65 and Y is 83; X is 65 and Y is 84; X is 65 and Y is 85; X is 65 and Y is 86; X is 65 and Y is 87; X is 65 and Y is 88; X is 65 and Y is 89; X is 65 and Y is 90; X is 65 and Y is 91; X is 65 and Y is 92; X is 65 and Y is 93; X is 65 and Y is 94; X is 65 and Y is 95; X is 65 and Y is 96; X is 65 and Y is 97; X is 65 and Y is 98; X is 65 and Y is 99; X is 65 and Y is 100; X is 65 and Y is 101; X is 65 and Y is 102; X is 65 and Y is 103; X is 65 and Y is 104; X is 65 and Y is 105; X is 65 and Y is 106; X is 65 and Y is 107; X is 65 and Y is 108; X is 65 and Y is 109; X is 65 and Y is 110; X is 65 and Y is 111; X is 65 and Y is 112; X is 65 and Y is 113; X is 65 and Y is 114; X is 65 and Y is 115; X is 65 and Y is 116; X is 65 and Y is 117; X is 65 and Y is 118; X is 65 and Y is 119; X is 65 and Y is 120; X is 65 and Y is 121; X is 65 and Y is 122; X is 65 and Y is 123; X is 65 and Y is 124; X is 65 and Y is 125; X is 65 and Y is 126; X is 65 and Y is 127; X is 65 and Y is 128; X is 65 and Y is 129; X is 65 and Y is 130; X is 65 and Y is 131; X is 65 and Y is 132; X is 65 and Y is 133; X is 65 and Y is 134; X is 65 and Y is 135; X is 65 and Y is 136; X is 65 and Y is 137; X is 65 and Y is 138; X is 65 and Y is 139; X is 65 and Y is 140; X is 65 and Y is 141; X is 65 and Y is 142; X is 65 and Y is 143; X is 65 and Y is 144; X is 65 and Y is 145; X is 65 and Y is 146; X is 65 and Y is 147; X is 65 and Y is 148; X is 65 and Y is 149; X is 65 and Y is 150; X is 65 and Y is 151; X is 65 and Y is 152; X is 65 and Y is 153; X is 65 and Y is 154; X is 65 and Y is 155; X is 65 and Y is 156; X is 65 and Y is 157; X is 65 and Y is 158; X is 65 and Y is 159; X is 65 and Y is 160; X is 65 and Y is 161; X is 65 and Y is 162; X is 65 and Y is 163; X is 65 and Y is 164; X is 65 and Y is 165; X is 65 and Y is 166; X is 65 and Y is 167; X is 65 and Y is 168; X is 65 and Y is 169; X is 65 and Y is 170; X is 65 and Y is 171; X is 65 and Y is 172; X is 65 and Y is 173; X is 65 and Y is 174; X is 65 and Y is 175; X is 65 and Y is 176; X is 65 and Y is 177; X is 65 and Y is 178; X is 65 and Y is 179; X is 65 and Y is 180; X is 65 and Y is 181; X is 65 and Y is 182; X is 65 and Y is 183; X is 65 and Y is 184; X is 65 and Y is 185; X is 65 and Y is 186; X is 66 and Y is 1; X is 66 and Y is 2; X is 66 and Y is 3; X is 66 and Y is 4; X is 66 and Y is 5; X is 66 and Y is 6; X is 66 and Y is 7; X is 66 and Y is 8; X is 66 and Y is 9; X is 66 and Y is 10; X is 66 and Y is 11; X is 66 and Y is 12; X is 66 and Y is 13; X is 66 and Y is 14; X is 66 and Y is 15; X is 66 and Y is 16; X is 66 and Y is 17; X is 66 and Y is 18; X is 66 and Y is 19; X is 66 and Y is 20; X is 66 and Y is 21; X is 66 and Y is 22; X is 66 and Y is 23; X is 66 and Y is 24; X is 66 and Y is 25; X is 66 and Y is 26; X is 66 and Y is 27; X is 66 and Y is 28; X is 66 and Y is 29; X is 66 and Y is 30; X is 66 and Y is 31; X is 66 and Y is 32; X is 66 and Y is 33; X is 66 and Y is 34; X is 66 and Y is 35; X is 66 and Y is 36; X is 66 and Y is 37; X is 66 and Y is 38; X is 66 and Y is 39; X is 66 and Y is 40; X is 66 and Y is 41; X is 66 and Y is 42; X is 66 and Y is 43; X is 66 and Y is 44; X is 66 and Y is 45; X is 66 and Y is 46; X is 66 and Y is 47; X is 66 and Y is 48; X is 66 and Y is 49; X is 66 and Y is 50; X is 66 and Y is 51; X is 66 and Y is 52; X is 66 and Y is 53; X is 66 and Y is 54; X is 66 and Y is 55; X is 66 and Y is 56; X is 66 and Y is 57; X is 66 and Y is 58; X is 66 and Y is 59; X is 66 and Y is 60; X is 66 and Y is 61; X is 66 and Y is 62; X is 66 and Y is 63; X is 66 and Y is 64; X is 66 and Y is 65; X is 66 and Y is 66; X is 66 and Y is 67; X is 66 and Y is 68; X is 66 and Y is 69; X is 66 and Y is 70; X is 66 and Y is 71; X is 66 and Y is 72; X is 66 and Y is 73; X is 66 and Y is 74; X is 66 and Y is 75; X is 66 and Y is 76; X is 66 and Y is 77; X is 66 and Y is 78; X is 66 and Y is 79; X is 66 and Y is 80; X is 66 and Y is 81; X is 66 and Y is 82; X is 66 and Y is 83; X is 66 and Y is 84; X is 66 and Y is 85; X is 66 and Y is 86; X is 66 and Y is 87; X is 66 and Y is 88; X is 66 and Y is 89; X is 66 and Y is 90; X is 66 and Y is 91; X is 66 and Y is 92; X is 66 and Y is 93; X is 66 and Y is 94; X is 66 and Y is 95; X is 66 and Y is 96; X is 66 and Y is 97; X is 66 and Y is 98; X is 66 and Y is 99; X is 66 and Y is 100; X is 66 and Y is 101; X is 66 and Y is 102; X is 66 and Y is 103; X is 66 and Y is 104; X is 66 and Y is 105; X is 66 and Y is 106; X is 66 and Y is 107; X is 66 and Y is 108; X is 66 and Y is 109; X is 66 and Y is 110; X is 66 and Y is 111; X is 66 and Y is 112; X is 66 and Y is 113; X is 66 and Y is 114; X is 66 and Y is 115; X is 66 and Y is 116; X is 66 and Y is 117; X is 66 and Y is 118; X is 66 and Y is 119; X is 66 and Y is 120; X is 66 and Y is 121; X is 66 and Y is 122; X is 66 and Y is 123; X is 66 and Y is 124; X is 66 and Y is 125; X is 66 and Y is 126; X is 66 and Y is 127; X is 66 and Y is 128; X is 66 and Y is 129; X is 66 and Y is 130; X is 66 and Y is 131; X is 66 and Y is 132; X is 66 and Y is 133; X is 66 and Y is 134; X is 66 and Y is 135; X is 66 and Y is 136; X is 66 and Y is 137; X is 66 and Y is 138; X is 66 and Y is 139; X is 66 and Y is 140; X is 66 and Y is 141; X is 66 and Y is 142; X is 66 and Y is 143; X is 66 and Y is 144; X is 66 and Y is 145; X is 66 and Y is 146; X is 66 and Y is 147; X is 66 and Y is 148; X is 66 and Y is 149; X is 66 and Y is 150; X is 66 and Y is 151; X is 66 and Y is 152; X is 66 and Y is 153; X is 66 and Y is 154; X is 66 and Y is 155; X is 66 and Y is 156; X is 66 and Y is 157; X is 66 and Y is 158; X is 66 and Y is 159; X is 66 and Y is 160; X is 66 and Y is 161; X is 66 and Y is 162; X is 66 and Y is 163; X is 66 and Y is 164; X is 66 and Y is 165; X is 66 and Y is 166; X is 66 and Y is 167; X is 66 and Y is 168; X is 66 and Y is 169; X is 66 and Y is 170; X is 66 and Y is 171; X is 66 and Y is 172; X is 66 and Y is 173; X is 66 and Y is 174; X is 66 and Y is 175; X is 66 and Y is 176; X is 66 and Y is 177; X is 66 and Y is 178; X is 66 and Y is 179; X is 66 and Y is 180; X is 66 and Y is 181; X is 66 and Y is 182; X is 66 and Y is 183; X is 66 and Y is 184; X is 66 and Y is 185; X is 66 and Y is 186; X is 67 and Y is 1; X is 67 and Y is 2; X is 67 and Y is 3; X is 67 and Y is 4; X is 67 and Y is 5; X is 67 and Y is 6; X is 67 and Y is 7; X is 67 and Y is 8; X is 67 and Y is 9; X is 67 and Y is 10; X is 67 and Y is 11; X is 67 and Y is 12; X is 67 and Y is 13; X is 67 and Y is 14; X is 67 and Y is 15; X is 67 and Y is 16; X is 67 and Y is 17; X is 67 and Y is 18; X is 67 and Y is 19; X is 67 and Y is 20; X is 67 and Y is 21; X is 67 and Y is 22; X is 67 and Y is 23; X is 67 and Y is 24; X is 67 and Y is 25; X is 67 and Y is 26; X is 67 and Y is 27; X is 67 and Y is 28; X is 67 and Y is 29; X is 67 and Y is 30; X is 67 and Y is 31; X is 67 and Y is 32; X is 67 and Y is 33; X is 67 and Y is 34; X is 67 and Y is 35; X is 67 and Y is 36; X is 67 and Y is 37; X is 67 and Y is 38; X is 67 and Y is 39; X is 67 and Y is 40; X is 67 and Y is 41; X is 67 and Y is 42; X is 67 and Y is 43; X is 67 and Y is 44; X is 67 and Y is 45; X is 67 and Y is 46; X is 67 and Y is 47; X is 67 and Y is 48; X is 67 and Y is 49; X is 67 and Y is 50; X is 67 and Y is 51; X is 67 and Y is 52; X is 67 and Y is 53; X is 67 and Y is 54; X is 67 and Y is 55; X is 67 and Y is 56; X is 67 and Y is 57; X is 67 and Y is 58; X is 67 and Y is 59; X is 67 and Y is 60; X is 67 and Y is 61; X is 67 and Y is 62; X is 67 and Y is 63; X is 67 and Y is 64; X is 67 and Y is 65; X is 67 and Y is 66; X is 67 and Y is 67; X is 67 and Y is 68; X is 67 and Y is 69; X is 67 and Y is 70; X is 67 and Y is 71; X is 67 and Y is 72; X is 67 and Y is 73; X is 67 and Y is 74; X is 67 and Y is 75; X is 67 and Y is 76; X is 67 and Y is 77; X is 67 and Y is 78; X is 67 and Y is 79; X is 67 and Y is 80; X is 67 and Y is 81; X is 67 and Y is 82; X is 67 and Y is 83; X is 67 and Y is 84; X is 67 and Y is 85; X is 67 and Y is 86; X is 67 and Y is 87; X is 67 and Y is 88; X is 67 and Y is 89; X is 67 and Y is 90; X is 67 and Y is 91; X is 67 and Y is 92; X is 67 and Y is 93; X is 67 and Y is 94; X is 67 and Y is 95; X is 67 and Y is 96; X is 67 and Y is 97; X is 67 and Y is 98; X is 67 and Y is 99; X is 67 and Y is 100; X is 67 and Y is 101; X is 67 and Y is 102; X is 67 and Y is 103; X is 67 and Y is 104; X is 67 and Y is 105; X is 67 and Y is 106; X is 67 and Y is 107; X is 67 and Y is 108; X is 67 and Y is 109; X is 67 and Y is 110; X is 67 and Y is 111; X is 67 and Y is 112; X is 67 and Y is 113; X is 67 and Y is 114; X is 67 and Y is 115; X is 67 and Y is 116; X is 67 and Y is 117; X is 67 and Y is 118; X is 67 and Y is 119; X is 67 and Y is 120; X is 67 and Y is 121; X is 67 and Y is 122; X is 67 and Y is 123; X is 67 and Y is 124; X is 67 and Y is 125; X is 67 and Y is 126; X is 67 and Y is 127; X is 67 and Y is 128; X is 67 and Y is 129; X is 67 and Y is 130; X is 67 and Y is 131; X is 67 and Y is 132; X is 67 and Y is 133; X is 67 and Y is 134; X is 67 and Y is 135; X is 67 and Y is 136; X is 67 and Y is 137; X is 67 and Y is 138; X is 67 and Y is 139; X is 67 and Y is 140; X is 67 and Y is 141; X is 67 and Y is 142; X is 67 and Y is 143; X is 67 and Y is 144; X is 67 and Y is 145; X is 67 and Y is 146; X is 67 and Y is 147; X is 67 and Y is 148; X is 67 and Y is 149; X is 67 and Y is 150; X is 67 and Y is 151; X is 67 and Y is 152; X is 67 and Y is 153; X is 67 and Y is 154; X is 67 and Y is 155; X is 67 and Y is 156; X is 67 and Y is 157; X is 67 and Y is 158; X is 67 and Y is 159; X is 67 and Y is 160; X is 67 and Y is 161; X is 67 and Y is 162; X is 67 and Y is 163; X is 67 and Y is 164; X is 67 and Y is 165; X is 67 and Y is 166; X is 67 and Y is 167; X is 67 and Y is 168; X is 67 and Y is 169; X is 67 and Y is 170; X is 67 and Y is 171; X is 67 and Y is 172; X is 67 and Y is 173; X is 67 and Y is 174; X is 67 and Y is 175; X is 67 and Y is 176; X is 67 and Y is 177; X is 67 and Y is 178; X is 67 and Y is 179; X is 67 and Y is 180; X is 67 and Y is 181; X is 67 and Y is 182; X is 67 and Y is 183; X is 67 and Y is 184; X is 67 and Y is 185; X is 67 and Y is 186; X is 68 and Y is 1; X is 68 and Y is 2; X is 68 and Y is 3; X is 68 and Y is 4; X is 68 and Y is 5; X is 68 and Y is 6; X is 68 and Y is 7; X is 68 and Y is 8; X is 68 and Y is 9; X is 68 and Y is 10; X is 68 and Y is 11; X is 68 and Y is 12; X is 68 and Y is 13; X is 68 and Y is 14; X is 68 and Y is 15; X is 68 and Y is 16; X is 68 and Y is 17; X is 68 and Y is 18; X is 68 and Y is 19; X is 68 and Y is 20; X is 68 and Y is 21; X is 68 and Y is 22; X is 68 and Y is 23; X is 68 and Y is 24; X is 68 and Y is 25; X is 68 and Y is 26; X is 68 and Y is 27; X is 68 and Y is 28; X is 68 and Y is 29; X is 68 and Y is 30; X is 68 and Y is 31; X is 68 and Y is 32; X is 68 and Y is 33; X is 68 and Y is 34; X is 68 and Y is 35; X is 68 and Y is 36; X is 68 and Y is 37; X is 68 and Y is 38; X is 68 and Y is 39; X is 68 and Y is 40; X is 68 and Y is 41; X is 68 and Y is 42; X is 68 and Y is 43; X is 68 and Y is 44; X is 68 and Y is 45; X is 68 and Y is 46; X is 68 and Y is 47; X is 68 and Y is 48; X is 68 and Y is 49; X is 68 and Y is 50; X is 68 and Y is 51; X is 68 and Y is 52; X is 68 and Y is 53; X is 68 and Y is 54; X is 68 and Y is 55; X is 68 and Y is 56; X is 68 and Y is 57; X is 68 and Y is 58; X is 68 and Y is 59; X is 68 and Y is 60; X is 68 and Y is 61; X is 68 and Y is 62; X is 68 and Y is 63; X is 68 and Y is 64; X is 68 and Y is 65; X is 68 and Y is 66; X is 68 and Y is 67; X is 68 and Y is 68; X is 68 and Y is 69; X is 68 and Y is 70; X is 68 and Y is 71; X is 68 and Y is 72; X is 68 and Y is 73; X is 68 and Y is 74; X is 68 and Y is 75; X is 68 and Y is 76; X is 68 and Y is 77; X is 68 and Y is 78; X is 68 and Y is 79; X is 68 and Y is 80; X is 68 and Y is 81; X is 68 and Y is 82; X is 68 and Y is 83; X is 68 and Y is 84; X is 68 and Y is 85; X is 68 and Y is 86; X is 68 and Y is 87; X is 68 and Y is 88; X is 68 and Y is 89; X is 68 and Y is 90; X is 68 and Y is 91; X is 68 and Y is 92; X is 68 and Y is 93; X is 68 and Y is 94; X is 68 and Y is 95; X is 68 and Y is 96; X is 68 and Y is 97; X is 68 and Y is 98; X is 68 and Y is 99; X is 68 and Y is 100; X is 68 and Y is 101; X is 68 and Y is 102; X is 68 and Y is 103; X is 68 and Y is 104; X is 68 and Y is 105; X is 68 and Y is 106; X is 68 and Y is 107; X is 68 and Y is 108; X is 68 and Y is 109; X is 68 and Y is 110; X is 68 and Y is 111; X is 68 and Y is 112; X is 68 and Y is 113; X is 68 and Y is 114; X is 68 and Y is 115; X is 68 and Y is 116; X is 68 Y is 117; X is 68 and Y is 118; X is 68 and Y is 119; X is 68 and Y is 110; X is 68 and Y is 121; X is 68 and Y is 122; X is 68 and Y is 123; X is 68 and Y is 124; X is 68 and Y is 125; X is 68 and Y is 126; X is 68 and Y is 127; X is 68 and Y is 128; X is 68 and Y is 129; X is 68 and Y is 130; X is 68 and Y is 131; X is 68 and Y is 132; X is 68 and Y is 133; X is 68 and Y is 134; X is 68 and Y is 135; X is 68 and Y is 136; X is 68 and Y is 137; X is 68 and Y is 138; X is 68 and Y is 139; X is 68 and Y is 140; X is 68 and Y is 141; X is 68 and Y is 142; X is 68 and Y is 143; X is 68 and Y is 144; X is 68 and Y is 145; X is 68 and Y is 146; X is 68 and Y is 147; X is 68 and Y is 148; X is 68 and Y is 149; X is 68 and Y is 150; X is 68 and Y is 151; X is 68 and Y is 152; X is 68 and Y is 153; X is 68 and Y is 154; X is 68 and Y is 155; X is 68 and Y is 156; X is 68 and Y is 157; X is 68 and Y is 158; X is 68 and Y is 159; X is 68 and Y is 160; X is 68 and Y is 161; X is 68 and Y is 162; X is 68 and Y is 163; X is 68 and Y is 164; X is 68 and Y is 165; X is 68 and Y is 166; X is 68 and Y is 167; X is 68 and Y is 168; X is 68 and Y is 169; X is 68 and Y is 170; X is 68 and Y is 171; X is 68 and Y is 172; X is 68 and Y is 173; X is 68 and Y is 174; X is 68 and Y is 175; X is 68 and Y is 176; X is 68 and Y is 177; X is 68 and Y is 178; X is 68 and Y is 179; X is 68 and Y is 180; X is 68 and Y is 181; X is 68 and Y is 182; X is 68 and Y is 183; X is 68 and Y is 184; X is 68 and Y is 185; X is 68 and Y is 186; X is 69 and Y is 1; X is 69 and Y is 2; X is 69 and Y is 3; X is 69 and Y is 4; X is 69 and Y is 5; X is 69 and Y is 6; X is 69 and Y is 7; X is 69 and Y is 8; X is 69 and Y is 9; X is 69 and Y is 10; X is 69 and Y is 11; X is 69 and Y is 12; X is 69 and Y is 13; X is 69 and Y is 14; X is 69 and Y is 15; X is 69 and Y is 16; X is 69 and Y is 17; X is 69 and Y is 18; X is 69 and Y is 19; X is 69 and Y is 20; X is 69 and Y is 21; X is 69 and Y is 22; X is 69 and Y is 23; X is 69 and Y is 24; X is 69 and Y is 25; X is 69 and Y is 26; X is 69 and Y is 27; X is 69 and Y is 28; X is 69 and Y is 29; X is 69 and Y is 30; X is 69 and Y is 31; X is 69 and Y is 32; X is 69 and Y is 33; X is 69 and Y is 34; X is 69 and Y is 35; X is 69 and Y is 36; X is 69 and Y is 37; X is 69 and Y is 38; X is 69 and Y is 39; X is 69 and Y is 40; X is 69 and Y is 41; X is 69 and Y is 42; X is 69 and Y is 43; X is 69 and Y is 44; X is 69 and Y is 45; X is 69 and Y is 46; X is 69 and Y is 47; X is 69 and Y is 48; X is 69 and Y is 49; X is 69 and Y is 50; X is 69 and Y is 51; X is 69 and Y is 52; X is 69 and Y is 53; X is 69 and Y is 54; X is 69 and Y is 55; X is 69 and Y is 56; X is 69 and Y is 57; X is 69 and Y is 58; X is 69 and Y is 59; X is 69 and Y is 60; X is 69 and Y is 61; X is 69 and Y is 62; X is 69 and Y is 63; X is 69 and Y is 64; X is 69 and Y is 65; X is 69 and Y is 66; X is 69 and Y is 67; X is 69 and Y is 68; X is 69 and Y is 69; X is 69 and Y is 70; X is 69 and Y is 71; X is 69 and Y is 72; X is 69 and Y is 73; X is 69 and Y is 74; X is 69 and Y is 75; X is 69 and Y is 76; X is 69 and Y is 77; X is 69 and Y is 78; X is 69 and Y is 79; X is 69 and Y is 80; X is 69 and Y is 81; X is 69 and Y is 82; X is 69 and Y is 83; X is 69 and Y is 84; X is 69 and Y is 85; X is 69 and Y is 86; X is 69 and Y is 87; X is 69 and Y is 88; X is 69 and Y is 89; X is 69 and Y is 90; X is 69 and Y is 91; X is 69 and Y is 92; X is 69 and Y is 93; X is 69 and Y is 94; X is 69 and Y is 95; X is 69 and Y is 96; X is 69 and Y is 97; X is 69 and Y is 98; X is 69 and Y is 99; X is 69 and Y is 100; X is 69 and Y is 101; X is 69 and Y is 102; X is 69 and Y is 103; X is 69 and Y is 104; X is 69 and Y is 105; X is 69 and Y is 106; X is 69 and Y is 107; X is 69 and Y is 108; X is 69 and Y is 109; X is 69 and Y is 110; X is 69 and Y is 111; X is 69 and Y is 112; X is 69 and Y is 113; X is 69 and Y is 114; X is 69 and Y is 115; X is 69 and Y is 116; X is 69 and Y is 117; X is 69 and Y is 118; X is 69 and Y is 119; X is 69 and Y is 120; X is 69 and Y is 121; X is 69 and Y is 122; X is 69 and Y is 123; X is 69 and Y is 124; X is 69 and Y is 125; X is 69 and Y is 126; X is 69 and Y is 127; X is 69 and Y is 128; X is 69 and Y is 129; X is 69 and Y is 130; X is 69 and Y is 131; X is 69 and Y is 132; X is 69 and Y is 133; X is 69 and Y is 134; X is 69 and Y is 135; X is 69 and Y is 136; X is 69 and Y is 137; X is 69 and Y is 138; X is 69 and Y is 139; X is 69 and Y is 140; X is 69 and Y is 141; X is 69 and Y is 142; X is 69 and Y is 143; X is 69 and Y is 144; X is 69 and Y is 145; X is 69 and Y is 146; X is 69 and Y is 147; X is 69 and Y is 148; X is 69 and Y is 149; X is 69 and Y is 150; X is 69 and Y is 151; X is 69 and Y is 152; X is 69 and Y is 153; X is 69 and Y is 154; X is 69 and Y is 155; X is 69 and Y is 156; X is 69 and Y is 157; X is 69 and Y is 158; X is 69 and Y is 159; X is 69 and Y is 160; X is 69 and Y is 161; X is 69 and Y is 162; X is 69 and Y is 163; X is 69 and Y is 164; X is 69 and Y is 165; X is 69 and Y is 166; X is 69 and Y is 167; X is 69 and Y is 168; X is 69 and Y is 169; X is 69 and Y is 170; X is 69 and Y is 171; X is 69 and Y is 172; X is 69 and Y is 173; X is 69 and Y is 174; X is 69 and Y is 175; X is 69 and Y is 176; X is 69 and Y is 177; X is 69 and Y is 178; X is 69 and Y is 179; X is 69 and Y is 180; X is 69 and Y is 181; X is 69 and Y is 182; X is 69 and Y is 183; X is 69 and Y is 184; X is 69 and Y is 185; X is 69 and Y is 186; X is 70 and Y is 1; X is 70 and Y is 2; X is 70 and Y is 3; X is 70 and Y is 4; X is 70 and Y is 5; X is 70 and Y is 6; X is 70 and Y is 7; X is 70 and Y is 8; X is 70 and Y is 9; X is 70 and Y is 10; X is 70 and Y is 11; X is 70 and Y is 12; X is 70 and Y is 13; X is 70 and Y is 14; X is 70 and Y is 15; X is 70 and Y is 16; X is 70 and Y is 17; X is 70 and Y is 18; X is 70 and Y is 19; X is 70 and Y is 20; X is 70 and Y is 21; X is 70 and Y is 22; X is 70 and Y is 23; X is 70 and Y is 24; X is 70 and Y is 25; X is 70 and Y is 26; X is 70 and Y is 27; X is 70 and Y is 28; X is 70 and Y is 29; X is 70 and Y is 30; X is 70 and Y is 31; X is 70 and Y is 32; X is 70 and Y is 33; X is 70 and Y is 34; X is 70 and Y is 35; X is 70 and Y is 36; X is 70 and Y is 37; X is 70 and Y is 38; X is 70 and Y is 39; X is 70 and Y is 40; X is 70 and Y is 41; X is 70 and Y is 42; X is 70 and Y is 43; X is 70 and Y is 44; X is 70 and Y is 45; X is 70 and Y is 46; X is 70 and Y is 47; X is 70 and Y is 48; X is 70 and Y is 49; X is 70 and Y is 50; X is 70 and Y is 51; X is 70 and Y is 52; X is 70 and Y is 53; X is 70 and Y is 54; X is 70 and Y is 55; X is 70 and Y is 56; X is 70 and Y is 57; X is 70 and Y is 58; X is 70 and Y is 59; X is 70 and Y is 60; X is 70 and Y is 61; X is 70 and Y is 62; X is 70 and Y is 63; X is 70 and Y is 64; X is 70 and Y is 65; X is 70 and Y is 66; X is 70 and Y is 67; X is 70 and Y is 68; X is 70 and Y is 69; X is 70 and Y is 70; X is 70 and Y is 71; X is 70 and Y is 72; X is 70 and Y is 73; X is 70 and Y is 74; X is 70 and Y is 75; X is 70 and Y is 76; X is 70 and Y is 77; X is 70 and Y is 78; X is 70 and Y is 79; X is 70 and Y is 80; X is 70 and Y is 81; X is 70 and Y is 82; X is 70 and Y is 83; X is 70 and Y is 84; X is 70 and Y is 85; X is 70 and Y is 86; X is 70 and Y is 87; X is 70 and Y is 88; X is 70 and Y is 89; X is 70 and Y is 90; X is 70 and Y is 91; X is 70 and Y is 92; X is 70 and Y is 93; X is 70 and Y is 94; X is 70 and Y is 95; X is 70 and Y is 96; X is 70 and Y is 97; X is 70 and Y is 98; X is 70 and Y is 99; X is 70 and Y is 100; X is 70 and Y is 101; X is 70 and Y is 102; X is 70 and Y is 103; X is 70 and Y is 104; X is 70 and Y is 105; X is 70 and Y is 106; X is 70 and Y is 107; X is 70 and Y is 108; X is 70 and Y is 109; X is 70 and Y is 110; X is 70 and Y is 111; X is 70 and Y is 112; X is 70 and Y is 113; X is 70 and Y is 114; X is 70 and Y is 115; X is 70 and Y is 116; X is 70 and Y is 117; X is 70 and Y is 118; X is 70 and Y is 119; X is 70 and Y is 120; X is 70 and Y is 121; X is 70 and Y is 122; X is 70 and Y is 123; X is 70 and Y is 124; X is 70 and Y is 125; X is 70 and Y is 126; X is 70 and Y is 127; X is 70 and Y is 128; X is 70 and Y is 129; X is 70 and Y is 130; X is 70 and Y is 131; X is 70 and Y is 132; X is 70 and Y is 133; X is 70 and Y is 134; X is 70 and Y is 135; X is 70 and Y is 136; X is 70 and Y is 137; X is 70 and Y is 138; X is 70 and Y is 139; X is 70 and Y is 140; X is 70 and Y is 141; X is 70 and Y is 142; X is 70 and Y is 143; X is 70 and Y is 144; X is 70 and Y is 145; X is 70 and Y is 146; X is 70 and Y is 147; X is 70 and Y is 148; X is 70 and Y is 149; X is 70 and Y is 150; X is 70 and Y is 151; X is 70 and Y is 152; X is 70 and Y is 153; X is 70 and Y is 154; X is 70 and Y is 155; X is 70 and Y is 156; X is 70 and Y is 157; X is 70 and Y is 158; X is 70 and Y is 159; X is 70 and Y is 160; X is 70 and Y is 161; X is 70 and Y is 162; X is 70 and Y is 163; X is 70 and Y is 164; X is 70 and Y is 165; X is 70 and Y is 166; X is 70 and Y is 167; X is 70 and Y is 168; X is 70 and Y is 169; X is 70 and Y is 170; X is 70 and Y is 171; X is 70 and Y is 172; X is 70 and Y is 173; X is 70 and Y is 174; X is 70 and Y is 175; X is 70 and Y is 176; X is 70 and Y is 177; X is 70 and Y is 178; X is 70 and Y is 179; X is 70 and Y is 180; X is 70 and Y is 181; X is 70 and Y is 182; X is 70 and Y is 183; X is 70 and Y is 184; X is 70 and Y is 185; X is 70 and Y is 186; X is 71 and Y is 1; X is 71 and Y is 2; X is 71 and Y is 3; X is 71 and Y is 4; X is 71 and Y is 5; X is 71 and Y is 6; X is 71 and Y is 7; X is 71 and Y is 8; X is 71 and Y is 9; X is 71 and Y is 10; X is 71 and Y is 11; X is 71 and Y is 12; X is 71 and Y is 13; X is 71 and Y is 14; X is 71 and Y is 15; X is 71 and Y is 16; X is 71 and Y is 17; X is 71 and Y is 18; X is 71 and Y is 19; X is 71 and Y is 20; X is 71 and Y is 21; X is 71 and Y is 22; X is 71 and Y is 23; X is 71 and Y is 24; X is 71 and Y is 25; X is 71 and Y is 26; X is 71 and Y is 27; X is 71 and Y is 28; X is 71 and Y is 29; X is 71 and Y is 30; X is 71 and Y is 31; X is 71 and Y is 32; X is 71 and Y is 33; X is 71 and Y is 34; X is 71 and Y is 35; X is 71 and Y is 36; X is 71 and Y is 37; X is 71 and Y is 38; X is 71 and Y is 39; X is 71 and Y is 40; X is 71 and Y is 41; X is 71 and Y is 42; X is 71 and Y is 43; X is 71 and Y is 44; X is 71 and Y is 45; X is 71 and Y is 46; X is 71 and Y is 47; X is 71 and Y is 48; X is 71 and Y is 49; X is 71 and Y is 50; X is 71 and Y is 51; X is 71 and Y is 52; X is 71 and Y is 53; X is 71 and Y is 54; X is 71 and Y is 55; X is 71 and Y is 56; X is 71 and Y is 57; X is 71 and Y is 58; X is 71 and Y is 59; X is 71 and Y is 60; X is 71 and Y is 61; X is 71 and Y is 62; X is 71 and Y is 63; X is 71 and Y is 64; X is 71 and Y is 65; X is 71 and Y is 66; X is 71 and Y is 67; X is 71 and Y is 68; X is 71 and Y is 69; X is 71 and Y is 70; X is 71 and Y is 71; X is 71 and Y is 72; X is 71 and Y is 73; X is 71 and Y is 74; X is 71 and Y is 75; X is 71 and Y is 76; X is 71 and Y is 77; X is 71 and Y is 78; X is 71 and Y is 79; X is 71 and Y is 80; X is 71 and Y is 81; X is 71 and Y is 82; X is 71 and Y is 83; X is 71 and Y is 84; X is 71 and Y is 85; X is 71 and Y is 86; X is 71 and Y is 87; X is 71 and Y is 88; X is 71 and Y is 89; X is 71 and Y is 90; X is 71 and Y is 91; X is 71 and Y is 92; X is 71 and Y is 93; X is 71 and Y is 94; X is 71 and Y is 95; X is 71 and Y is 96; X is 71 and Y is 97; X is 71 and Y is 98; X is 71 and Y is 99; X is 71 and Y is 100; X is 71 and Y is 101; X is 71 and Y is 102; X is 71 and Y is 103; X is 71 and Y is 104; X is 71 and Y is 105; X is 71 and Y is 106; X is 71 and Y is 107; X is 71 and Y is 108; X is 71 and Y is 109; X is 71 and Y is 110; X is 71 and Y is 111; X is 71 and Y is 112; X is 71 and Y is 113; X is 71 and Y is 114; X is 71 and Y is 115; X is 71 and Y is 116; X is 71 and Y is 117; X is 71 and Y is 118; X is 71 and Y is 119; X is 71 and Y is 120; X is 71 and Y is 121; X is 71 and Y is 122; X is 71 and Y is 123; X is 71 and Y is 124; X is 71 and Y is 125; X is 71 and Y is 126; X is 71 and Y is 127; X is 71 and Y is 128; X is 71 and Y is 129; X is 71 and Y is 130; X is 71 and Y is 131; X is 71 and Y is 132; X is 71 and Y is 133; X is 71 and Y is 134; X is 71 and Y is 135; X is 71 and Y is 136; X is 71 and Y is 137; X is 71 and Y is 138; X is 71 and Y is 139; X is 71 and Y is 140; X is 71 and Y is 141; X is 71 and Y is 142; X is 71 and Y is 143; X is 71 and Y is 144; X is 71 and Y is 145; X is 71 and Y is 146; X is 71 and Y is 147; X is 71 and Y is 148; X is 71 and Y is 149; X is 71 and Y is 150; X is 71 and Y is 151; X is 71 and Y is 152; X is 71 and Y is 153; X is 71 and Y is 154; X is 71 and Y is 155; X is 71 and Y is 156; X is 71 and Y is 157; X is 71 and Y is 158; X is 71 and Y is 159; X is 71 and Y is 160; X is 71 and Y is 161; X is 71 and Y is 162; X is 71 and Y is 163; X is 71 and Y is 164; X is 71 and Y is 165; X is 71 and Y is 166; X is 71 and Y is 167; X is 71 and Y is 168; X is 71 and Y is 169; X is 71 and Y is 170; X is 71 and Y is 171; X is 71 and Y is 172; X is 71 and Y is 173; X is 71 and Y is 174; X is 71 and Y is 175; X is 71 and Y is 176; X is 71 and Y is 177; X is 71 and Y is 178; X is 71 and Y is 179; X is 71 and Y is 180; X is 71 and Y is 181; X is 71 and Y is 182; X is 71 and Y is 183; X is 71 and Y is 184; X is 71 and Y is 185; X is 71 and Y is 186;
X is 72 and Y is 1; X is 72 and Y is 2; X is 72 and Y is 3; X is 72 and Y is 4; X is 72 and Y is 5; X is 72 and Y is 6; X is 72 and Y is 7; X is 72 and Y is 8; X is 72 and Y is 9; X is 72 and Y is 10; X is 72 and Y is 11; X is 72 and Y is 12; X is 72 and Y is 13; X is 72 and Y is 14; X is 72 and Y is 15; X is 72 and Y is 16; X is 72 and Y is 17; X is 72 and Y is 18; X is 72 and Y is 19; X is 72 and Y is 20; X is 72 and Y is 21; X is 72 and Y is 22; X is 72 and Y is 23; X is 72 and Y is 24; X is 72 and Y is 25; X is 72 and Y is 26; X is 72 and Y is 27; X is 72 and Y is 28; X is 72 and Y is 29; X is 72 and Y is 30; X is 72 and Y is 31; X is 72 and V is 32; X is 72 and Y is 33; X is 72 and Y is 34; X is 72 and Y is 35; X is 72 and Y is 36; X is 72 and Y is 37; X is 72 and Y is 38; X is 72 and Y is 39; X is 72 and Y is 40; X is 72 and Y is 41; X is 72 and Y is 42; X is 72 and Y is 43; X is 72 and Y is 44; X is 72 and Y is 45; X is 72 and Y is 46; X is 72 and Y is 47; X is 72 and Y is 48; X is 72 and Y is 49; X is 72 and Y is 50; X is 72 and Y is 51; X is 72 and Y is 52; X is 72 and Y is 53; X is 72 and Y is 54; X is 72 and Y is 55; X is 72 and Y is 56; X is 72 and Y is 57; X is 72 and Y is 58; X is 72 and Y is 59; X is 72 and Y is 60; X is 72 and Y is 61; X is 72 and Y is 62; X is 72 and Y is 63; X is 72 and Y is 64; X is 72 and Y is 65; X is 72 and Y is 66; X is 72 and Y is 67; X is 72 and Y is 68; X is 72 and Y is 69; X is 72 and Y is 70; X is 72 and Y is 71; X is 72 and Y is 72; X is 72 and Y is 73; X is 72 and Y is 74; X is 72 and Y is 75; X is 72 and Y is 76; X is 72 and Y is 77; X is 72 and Y is 78; X is 72 and Y is 79; X is 72 and Y is 80; X is 72 and Y is 81; X is 72 and Y is 82; X is 72 and Y is 83; X is 72 and Y is 84; X is 72 and Y is 85; X is 72 and Y is 86; X is 72 and Y is 87; X is 72 and Y is 88; X is 72 and Y is 89; X is 72 and Y is 90; X is 72 and Y is 91; X is 72 and Y is 92; X is 72 and Y is 93; X is 72 and Y is 94; X is 72 and Y is 95; X is 72 and Y is 96; X is 72 and Y is 97; X is 72 and Y is 98; X is 72 and Y is 99; X is 72 and Y is 100; X is 72 and Y is 101; X is 72 and Y is 102; X is 72 and Y is 103; X is 72 and Y is 104; X is 72 and Y is 105; X is 72 and Y is 106; X is 72 and Y is 107; X is 72 and Y is 108; X is 72 and Y is 109; X is 72 and Y is 110; X is 72 and Y is 111; X is 72 and Y is 112; X is 72 and Y is 113; X is 72 and Y is 114; X is 72 and Y is 115; X is 72 and Y is 116; X is 72 and Y is 117; X is 72 and Y is 118; X is 72 and Y is 119; X is 72 and Y is 120; X is 72 and Y is 121; X is 72 and Y is 122; X is 72 and Y is 123; X is 72 and Y is 124; X is 72 and Y is 125; X is 72 and Y is 126; X is 72 and Y is 127; X is 72 and Y is 128; X is 72 and Y is 129; X is 72 and Y is 130; X is 72 and Y is 131; X is 72 and Y is 132; X is 72 and Y is 133; X is 72 and Y is 134; X is 72 and Y is 135; X is 72 and Y is 136; X is 72 and Y is 137; X is 72 and Y is 138; X is 72 and Y is 139; X is 72 and Y is 140; X is 72 and Y is 141; X is 72 and Y is 142; X is 72 and Y is 143; X is 72 and Y is 144; X is 72 and Y is 145; X is 72 and Y is 146; X is 72 and Y is 147; X is 72 and Y is 148; X is 72 and Y is 149; X is 72 and Y is 150; X is 72 and Y is 151; X is 72 and Y is 152; X is 72 and Y is 153; X is 72 and Y is 154; X is 72 and Y is 155; X is 72 and Y is 156; X is 72 and Y is 157; X is 72 and Y is 158; X is 72 and Y is 159; X is 72 and Y is 160; X is 72 and Y is 161; X is 72 and Y is 162; X is 72 and Y is 163; X is 72 and Y is 164; X is 72 and Y is 165; X is 72 and Y is 166; X is 72 and Y is 167; X is 72 and Y is 168; X is 72 and Y is 169; X is 72 and Y is 170; X is 72 and Y is 171; X is 72 and Y is 172; X is 72 and Y is 173; X is 72 and Y is 174; X is 72 and Y is 175; X is 72 and Y is 176; X is 72 and Y is 177; X is 72 and Y is 178; X is 72 and Y is 179; X is 72 and Y is 180; X is 72 and Y is 181; X is 72 and Y is 182; X is 72 and Y is 183; X is 72 and Y is 184; X is 72 and Y is 185; X is 72 and Y is 186;
X is 73 and Y is 1; X is 73 and Y is 2; X is 73 and Y is 3; X is 73 and Y is 4; X is 73 and Y is 5; X is 73 and Y is 6; X is 73 and Y is 7; X is 73 and Y is 8; X is 73 and Y is 9; X is 73 and Y is 10; X is 73 and Y is 11; X is 73 and Y is 12; X is 73 and Y is 13; X is 73 and Y is 14; X is 73 and Y is 15; X is 73 and Y is 16; X is 73 and Y is 17; X is 73 and Y is 18; X is 73 and Y is 19; X is 73 and Y is 20; X is 73 and Y is 21; X is 73 and Y is 22; X is 73 and Y is 23; X is 73 and Y is 24; X is 73 and Y is 25; X is 73 and Y is 26; X is 73 and Y is 27; X is 73 and Y is 28; X is 73 and Y is 29; X is 73 and Y is 30; X is 73 and Y is 31; X is 73 and Y is 32; X is 73 and Y is 33; X is 73 and Y is 34; X is 73 and Y is 35; X is 73 and Y is 36; X is 73 and Y is 37; X is 73 and Y is 38; X is 73 and Y is 39; X is 73 and Y is 40; X is 73 and Y is 41; X is 73 and Y is 42; X is 73 and Y is 43; X is 73 and Y is 44; X is 73 and Y is 45; X is 73 and Y is 46; X is 73 and Y is 47; X is 73 and Y is 48; X is 73 and Y is 49; X is 73 and Y is 50; X is 73 and Y is 51; X is 73 and Y is 52; X is 73 and Y is 53; X is 73 and Y is 54; X is 73 and Y is 55; X is 73 and Y is 56; X is 73 and Y is 57; X is 73 and Y is 58; X is 73 and Y is 59; X is 73 and Y is 60; X is 73 and Y is 61; X is 73 and Y is 62; X is 73 and Y is 63; X is 73 and Y is 64; X is 73 and Y is 65; X is 73 and Y is 66; X is 73 and Y is 67; X is 73 and Y is 68; X is 73 and Y is 69; X is 73 and Y is 70; X is 73 and Y is 71; X is 73 and Y is 72; X is 73 and Y is 73; X is 73 and Y is 74; X is 73 and Y is 75; X is 73 and Y is 76; X is 73 and Y is 77; X is 73 and Y is 78; X is 73 and Y is 79; X is 73 and Y is 80; X is 73 and Y is 81; X is 73 and Y is 82; X is 73 and Y is 83; X is 73 and Y is 84; X is 73 and Y is 85; X is 73 and Y is 86; X is 73 and Y is 87; X is 73 and Y is 88; X is 73 and Y is 89; X is 73 and Y is 90; X is 73 and Y is 91; X is 73 and Y is 92; X is 73 and Y is 93; X is 73 and Y is 94; X is 73 and Y is 95; X is 73 and Y is 96; X is 73 and Y is 97; X is 73 and Y is 98; X is 73 and Y is 99; X is 73 and Y is 100; X is 73 and Y is 101; X is 73 and Y is 102; X is 73 and Y is 103; X is 73 and Y is 104; X is 73 and Y is 105; X is 73 and Y is 106; X is 73 and Y is 107; X is 73 and Y is 108; X is 73 and Y is 109; X is 73 and Y is 110; X is 73 and Y is 111; X is 73 and Y is 112; X is 73 and Y is 113; X is 73 and Y is 114; X is 73 and Y is 115; X is 73 and Y is 116; X is 73 and Y is 117; X is 73 and Y is 118; X is 73 and Y is 119; X is 73 and Y is 120; X is 73 and Y is 121; X is 73 and Y is 122; X is 73 and Y is 123; X is 73 and Y is 124; X is 73 and Y is 125; X is 73 and Y is 126; X is 73 and Y is 127; X is 73 and Y is 128; X is 73 and Y is 129; X is 73 and Y is 130; X is 73 and Y is 131; X is 73 and Y is 132; X is 73 and Y is 133; X is 73 and Y is 134; X is 73 and Y is 135; X is 73 and Y is 136; X is 73 and Y is 137; X is 73 and Y is 138; X is 73 and Y is 139; X is 73 and Y is 140; X is 73 and Y is 141; X is 73 and Y is 142; X is 73 and Y is 143; X is 73 and Y is 144; X is 73 and Y is 145; X is 73 and Y is 146; X is 73 and Y is 147; X is 73 and Y is 148; X is 73 and Y is 149; X is 73 and Y is 150; X is 73 and Y is 151; X is 73 and Y is 152; X is 73 and Y is 153; X is 73 and Y is 154; X is 73 and Y is 155; X is 73 and Y is 156; X is 73 and Y is 157; X is 73 and Y is 158; X is 73 and Y is 159; X is 73 and Y is 160; X is 73 and Y is 161; X is 73 and Y is 162; X is 73 and Y is 163; X is 73 and Y is 164; X is 73 and Y is 165; X is 73 and Y is 166; X is 73 and Y is 167; X is 73 and Y is 168; X is 73 and Y is 169; X is 73 and Y is 170; X is 73 and Y is 171; X is 73 and Y is 172; X is 73 and Y is 173; X is 73 and Y is 174; X is 73 and Y is 175; X is 73 and Y is 176; X is 73 and Y is 177; X is 73 and Y is 178; X is 73 and Y is 179; X is 73 and Y is 180; X is 73 and Y is 181; X is 73 and Y is 182; X is 73 and Y is 183; X is 73 and Y is 184; X is 73 and Y is 185; X is 73 and Y is 186; X is 74 and Y is 1; X is 74 and Y is 2; X is 74 and Y is 3; X is 74 and Y is 4; X is 74 and Y is 5; X is 74 and Y is 6; X is 74 and Y is 7; X is 74 and Y is 8; X is 74 and Y is 9; X is 74 and Y is 10; X is 74 and Y is 11; X is 74 and Y is 12; X is 74 and Y is 13; X is 74 and Y is 14; X is 74 and Y is 15; X is 74 and Y is 16; X is 74 and Y is 17; X is 74 and Y is 18; X is 74 and Y is 19; X is 74 and Y is 20; X is 74 and Y is 21; X is 74 and Y is 22; X is 74 and Y is 23; X is 74 and Y is 24; X is 74 and Y is 25; X is 74 and Y is 26; X is 74 and Y is 27; X is 74 and Y is 28; X is 74 and Y is 29; X is 74 and Y is 30; X is 74 and Y is 31; X is 74 and Y is 32; X is 74 and Y is 33; X is 74 and Y is 34; X is 74 and Y is 35; X is 74 and Y is 36; X is 74 and Y is 37; X is 74 and Y is 38; X is 74 and Y is 39; X is 74 and Y is 40; X is 74 and Y is 41; X is 74 and Y is 42; X is 74 and Y is 43; X is 74 and Y is 44; X is 74 and Y is 45; X is 74 and Y is 46; X is 74 and Y is 47; X is 74 and Y is 48; X is 74 and Y is 49; X is 74 and Y is 50; X is 74 and Y is 51; X is 74 and Y is 52; X is 74 and Y is 53; X is 74 and Y is 54; X is 74 and Y is 55; X is 74 and Y is 56; X is 74 and Y is 57; X is 74 and Y is 58; X is 74 and Y is 59; X is 74 and Y is 60; X is 74 and Y is 61; X is 74 and Y is 62; X is 74 and Y is 63; X is 74 and Y is 64; X is 74 and Y is 65; X is 74 and Y is 66; X is 74 and Y is 67; X is 74 and Y is 68; X is 74 and Y is 69; X is 74 and Y is 70; X is 74 and Y is 71; X is 74 and Y is 72; X is 74 and Y is 73; X is 74 and Y is 74; X is 74 and Y is 75; X is 74 and Y is 76; X is 74 and Y is 77; X is 74 and Y is 78; X is 74 and Y is 79; X is 74 and Y is 80; X is 74 and Y is 81; X is 74 and Y is 82; X is 74 and Y is 83; X is 74 and Y is 84; X is 74 and Y is 85; X is 74 and Y is 86; X is 74 and Y is 87; X is 74 and Y is 88; X is 74 and Y is 89; X is 74 and Y is 90; X is 74 and Y is 91; X is 74 and Y is 92; X is 74 and Y is 93; X is 74 and Y is 94; X is 74 and Y is 95; X is 74 and Y is 96; X is 74 and Y is 97; X is 74 and Y is 98; X is 74 and Y is 99; X is 74 and Y is 100; X is 74 and Y is 101; X is 74 and Y is 102; X is 74 and Y is 103; X is 74 and Y is 104; X is 74 and Y is 105; X is 74 and Y is 106; X is 74 and Y is 107; X is 74 and Y is 108; X is 74 and Y is 109; X is 74 and Y is 110; X is 74 and Y is 111; X is 74 and Y is 112; X is 74 and Y is 113; X is 74 and Y is 114; X is 74 and Y is 115; X is 74 and Y is 116; X is 74 and Y is 117; X is 74 and Y is 118; X is 74 and Y is 119; X is 74 and Y is 120; X is 74 and Y is 121; X is 74 and Y is 122; X is 74 and Y is 123; X is 74 and Y is 124; X is 74 and Y is 125; X is 74 and Y is 126; X is 74 and Y is 127; X is 74 and Y is 128; X is 74 and Y is 129; X is 74 and Y is 130; X is 74 and Y is 131; X is 74 and Y is 132; X is 74 and Y is 133; X is 74 and Y is 134; X is 74 and Y is 135; X is 74 and Y is 136; X is 74 and Y is 137; X is 74 and Y is 138; X is 74 and Y is 139; X is 74 and Y is 140; X is 74 and Y is 141; X is 74 and Y is 142; X is 74 and Y is 143; X is 74 and Y is 144; X is 74 and Y is 145; X is 74 and Y is 146; X is 74 and Y is 147; X is 74 and Y is 148; X is 74 and Y is 149; X is 74 and Y is 150; X is 74 and Y is 151; X is 74 and Y is 152; X is 74 and Y is 153; X is 74 and Y is 154; X is 74 and Y is 155; X is 74 and Y is 156; X is 74 and Y is 157; X is 74 and Y is 158; X is 74 and Y is 159; X is 74 and Y is 160; X is 74 and Y is 161; X is 74 and Y is 162; X is 74 and Y is 163; X is 74 and Y is 164; X is 74 and Y is 165; X is 74 and Y is 166; X is 74 and Y is 167; X is 74 and Y is 168; X is 74 and Y is 169; X is 74 and Y is 170; X is 74 and Y is 171; X is 74 and Y is 172; X is 74 and Y is 173; X is 74 and Y is 174; X is 74 and Y is 175; X is 74 and Y is 176; X is 74 and Y is 177; X is 74 and Y is 178; X is 74 and Y is 179; X is 74 and Y is 180; X is 74 and Y is 181; X is 74 and Y is 182; X is 74 and Y is 183; X is 74 and Y is 184; X is 74 and Y is 185; X is 74 and Y is 186; X is 75 and Y is 1; X is 75 and Y is 2; X is 75 and Y is 3; X is 75 and Y is 4; X is 75 and Y is 5; X is 75 and Y is 6; X is 75 and Y is 7; X is 75 and Y is 8; X is 75 and Y is 9; X is 75 and Y is 10; X is 75 and Y is 11; X is 75 and Y is 12; X is 75 and Y is 13; X is 75 and Y is 14; X is 75 and Y is 15; X is 75 and Y is 16; X is 75 and Y is 17; X is 75 and Y is 18; X is 75 and Y is 19; X is 75 and Y is 20; X is 75 and Y is 21; X is 75 and Y is 22; X is 75 and Y is 23; X is 75 and Y is 24; X is 75 and Y is 25; X is 75 and Y is 26; X is 75 and Y is 27; X is 75 and Y is 28; X is 75 and Y is 29; X is 75 and Y is 30; X is 75 and Y is 31; X is 75 and Y is 32; X is 75 and Y is 33; X is 75 and Y is 34; X is 75 and Y is 35; X is 75 and Y is 36; X is 75 and Y is 37; X is 75 and Y is 38; X is 75 and Y is 39; X is 75 and Y is 40; X is 75 and Y is 41; X is 75 and Y is 42; X is 75 and Y is 43; X is 75 and Y is 44; X is 75 and Y is 45; X is 75 and Y is 46; X is 75 and Y is 47; X is 75 and Y is 48; X is 75 and Y is 49; X is 75 and Y is 50; X is 75 and Y is 51; X is 75 and Y is 52; X is 75 and Y is 53; X is 75 and Y is 54; X is 75 and Y is 55; X is 75 and Y is 56; X is 75 and Y is 57; X is 75 and Y is 58; X is 75 and Y is 59; X is 75 and Y is 60; X is 75 and Y is 61; X is 75 and Y is 62; X is 75 and Y is 63; X is 75 and Y is 64; X is 75 and Y is 65; X is 75 and Y is 66; X is 75 and Y is 67; X is 75 and Y is 68; X is 75 and Y is 69; X is 75 and Y is 70; X is 75 and Y is 71; X is 75 and Y is 72; X is 75 and Y is 73; X is 75 and Y is 74; X is 75 and Y is 75; X is 75 and Y is 76; X is 75 and Y is 77; X is 75 and Y is 78; X is 75 and Y is 79; X is 75 and Y is 80; X is 75 and Y is 81; X is 75 and Y is 82; X is 75 and Y is 83; X is 75 and Y is 84; X is 75 and Y is 85; X is 75 and Y is 86; X is 75 and Y is 87; X is 75 and Y is 88; X is 75 and Y is 89; X is 75 and Y is 90; X is 75 and Y is 91; X is 75 and Y is 92; X is 75 and Y is 93; X is 75 and Y is 94; X is 75 and Y is 95; X is 75 and Y is 96; X is 75 and Y is 97; X is 75 and Y is 98; X is 75 and Y is 99; X is 75 and Y is 100; X is 75 and Y is 101; X is 75 and Y is 102; X is 75 and Y is 103; X is 75 and Y is 104; X is 75 and Y is 105; X is 75 and Y is 106; X is 75 and Y is 107; X is 75 and Y is 108; X is 75 and Y is 109; X is 75 and Y is 110; X is 75 and Y is 111; X is 75 and Y is 112; X is 75 and Y is 113; X is 75 and Y is 114; X is 75 and Y is 115; X is 75 and Y is 116; X is 75 and Y is 117; X is 75 and Y is 118; X is 75 and Y is 119; X is 75 and Y is 120; X is 75 and Y is 121; X is 75 and Y is 122; X is 75 and Y is 123; X is 75 and Y is 124; X is 75 and Y is 125; X is 75 and Y is 126; X is 75 and Y is 127; X is 75 and Y is 128; X is 75 and Y is 129; X is 75 and Y is 130; X is 75 and Y is 131; X is 75 and Y is 132; X is 75 and Y is 133; X is 75 and Y is 134; X is 75 and Y is 135; X is 75 and Y is 136; X is 75 and Y is 137; X is 75 and Y is 138; X is 75 and Y is 139; X is 75 and Y is 140; X is 75 and Y is 141; X is 75 and Y is 142; X is 75 and Y is 143; X is 75 and Y is 144; X is 75 and Y is 145; X is 75 and Y is 146; X is 75 and Y is 147; X is 75 and Y is 148; X is 75 and Y is 149; X is 75 and Y is 150; X is 75 and Y is 151; X is 75 and Y is 152; X is 75 and Y is 153; X is 75 and Y is 154; X is 75 and Y is 155; X is 75 and Y is 156; X is 75 and Y is 157; X is 75 and Y is 158; X is 75 and Y is 159; X is 75 and Y is 160; X is 75 and Y is 161; X is 75 and Y is 162; X is 75 and Y is 163; X is 75 and Y is 164; X is 75 and Y is 165; X is 75 and Y is 166; X is 75 and Y is 167; X is 75 and Y is 168; X is 75 and Y is 169; X is 75 and Y is 170; X is 75 and Y is 171; X is 75 and Y is 172; X is 75 and Y is 173; X is 75 and Y is 174; X is 75 and Y is 175; X is 75 and Y is 176; X is 75 and Y is 177; X is 75 and Y is 178; X is 75 and Y is 179; X is 75 and Y is 180; X is 75 and Y is 181; X is 75 and Y is 182; X is 75 and Y is 183; X is 75 and Y is 184; X is 75 and Y is 185; X is 75 and Y is 186; X is 76 and Y is 1; X is 76 and Y is 2; X is 76 and Y is 3; X is 76 and Y is 4; X is 76 and Y is 5; X is 76 and Y is 6; X is 76 and Y is 7; X is 76 and Y is 8; X is 76 and Y is 9; X is 76 and Y is 10; X is 76 and Y is 11; X is 76 and Y is 12; X is 76 and Y is 13; X is 76 and Y is 14; X is 76 and Y is 15; X is 76 and Y is 16; X is 76 and Y is 17; X is 76 and Y is 18; X is 76 and Y is 19; X is 76 and Y is 20; X is 76 and Y is 21; X is 76 and Y is 22; X is 76 and Y is 23; X is 76 and Y is 24; X is 76 and Y is 25; X is 76 and Y is 26; X is 76 and Y is 27; X is 76 and Y is 28; X is 76 and Y is 29; X is 76 and Y is 30; X is 76 and Y is 31; X is 76 and Y is 32; X is 76 and Y is 33; X is 76 and Y is 34; X is 76 and Y is 35; X is 76 and Y is 36; X is 76 and Y is 37; X is 76 and Y is 38; X is 76 and Y is 39; X is 76 and Y is 40; X is 76 and Y is 41; X is 76 and Y is 42; X is 76 and Y is 43; X is 76 and Y is 44; X is 76 and Y is 45; X is 76 and Y is 46; X is 76 and Y is 47; X is 76 and Y is 48; X is 76 and Y is 49; X is 76 and Y is 50; X is 76 and Y is 51; X is 76 and Y is 52; X is 76 and Y is 53; X is 76 and Y is 54; X is 76 and Y is 55; X is 76 and Y is 56; X is 76 and Y is 57; X is 76 and Y is 58; X is 76 and Y is 59; X is 76 and Y is 60; X is 76 and Y is 61; X is 76 and Y is 62; X is 76 and Y is 63; X is 76 and Y is 64; X is 76 and Y is 65; X is 76 and Y is 66; X is 76 and Y is 67; X is 76 and Y is 68; X is 76 and Y is 69; X is 76 and Y is 70; X is 76 and Y is 71; X is 76 and Y is 72; X is 76 and Y is 73; X is 76 and Y is 74; X is 76 and Y is 75; X is 76 and Y is 76; X is 76 and Y is 77; X is 76 and Y is 78; X is 76 and Y is 79; X is 76 and Y is 80; X is 76 and Y is 81; X is 76 and Y is 82; X is 76 and Y is 83; X is 76 and Y is 84; X is 76 and Y is 85; X is 76 and Y is 86; X is 76 and Y is 87; X is 76 and Y is 88; X is 76 and Y is 89; X is 76 and Y is 90; X is 76 and Y is 91; X is 76 and Y is 92; X is 76 and Y is 93; X is 76 and Y is 94; X is 76 and Y is 95; X is 76 and Y is 96; X is 76 and Y is 97; X is 76 and Y is 98; X is 76 and Y is 99; X is 76 and Y is 100; X is 76 and Y is 101; X is 76 and Y is 102; X is 76 and Y is 103; X is 76 and Y is 104; X is 76 and Y is 105; X is 76 and Y is 106; X is 76 and Y is 107; X is 76 and Y is 108; X is 76 and Y is 109; X is 76 and Y is 110; X is 76 and Y is 111; X is 76 and Y is 112; X is 76 and Y is 113; X is 76 and Y is 114; X is 76 and Y is 115; X is 76 and Y is 116; X is 76 and Y is 117; X is 76 and Y is 118; X is 76 and Y is 119; X is 76 and Y is 120; X is 76 and Y is 121; X is 76 and Y is 122; X is 76 and Y is 123; X is 76 and Y is 124; X is 76 and Y is 125; X is 76 and Y is 126; X is 76 and Y is 127; X is 76 and Y is 128; X is 76 and Y is 129; X is 76 and Y is 130; X is 76 and Y is 131; X is 76 and Y is 132; X is 76 and Y is 133; X is 76 and Y is 134; X is 76 and Y is 135; X is 76 and Y is 136; X is 76 and Y is 137; X is 76 and Y is 138; X is 76 and Y is 139; X is 76 and Y is 140; X is 76 and Y is 141; X is 76 and Y is 142; X is 76 and Y is 143; X is 76 and Y is 144; X is 76 and Y is 145; X is 76 and Y is 146; X is 76 and Y is 147; X is 76 and Y is 148; X is 76 and Y is 149; X is 76 and Y is 150; X is 76 and Y is 151; X is 76 and Y is 152; X is 76 and Y is 153; X is 76 and Y is 154; X is 76 and Y is 155; X is 76 and Y is 156; X is 76 and Y is 157; X is 76 and Y is 158; X is 76 and Y is 159; X is 76 and Y is 160; X is 76 and Y is 161; X is 76 and Y is 162; X is 76 and Y is 163; X is 76 and Y is 164; X is 76 and Y is 165; X is 76 and Y is 166; X is 76 and Y is 167; X is 76 and Y is 168; X is 76 and Y is 169; X is 76 and Y is 170; X is 76 and Y is 171; X is 76 and Y is 172; X is 76 and Y is 173; X is 76 and Y is 174; X is 76 and Y is 175; X is 76 and Y is 176; X is 76 and Y is 177; X is 76 and Y is 178; X is 76 and Y is 179; X is 76 and Y is 180; X is 76 and Y is 181; X is 76 and Y is 182; X is 76 and Y is 183; X is 76 and Y is 184; X is 76 and Y is 185; X is 76 and Y is 186; X is 77 and Y is 1; X is 77 and Y is 2; X is 77 and Y is 3; X is 77 and Y is 4; X is 77 and Y is 5; X is 77 and Y is 6; X is 77 and Y is 7; X is 77 and Y is 8; X is 77 and Y is 9; X is 77 and Y is 10; X is 77 and Y is 11; X is 77 and Y is 12; X is 77 and Y is 13; X is 77 and Y is 14; X is 77 and Y is 15; X is 77 and Y is 16; X is 77 and Y is 17; X is 77 and Y is 18; X is 77 and Y is 19; X is 77 and Y is 20; X is 77 and Y is 21; X is 77 and Y is 22; X is 77 and Y is 23; X is 77 and Y is 24; X is 77 and Y is 25; X is 77 and Y is 26; X is 77 and Y is 27; X is 77 and Y is 28; X is 77 and Y is 29; X is 77 and Y is 30; X is 77 and Y is 31; X is 77 and Y is 32; X is 77 and Y is 33; X is 77 and Y is 34; X is 77 and Y is 35; X is 77 and Y is 36; X is 77 and Y is 37; X is 77 and Y is 38; X is 77 and Y is 39; X is 77 and Y is 40; X is 77 and Y is 41; X is 77 and Y is 42; X is 77 and Y is 43; X is 77 and Y is 44; X is 77 and Y is 45; X is 77 and is 46; X is 77 and Y is 47; X is 77 and Y is 48; X is 77 and Y is 49; X is 77 and Y is 50; X is 77 and Y is 51; X is 77 and Y is 52; X is 77 and Y is 53; X is 77 and Y is 54; X is 77 and Y is 55; X is 77 and Y is 56; X is 77 and Y is 57; X is 77 and Y is 58; X is 77 and Y is 59; X is 77 and Y is 60; X is 77 and Y is 61; X is 77 and Y is 62; X is 77 and Y is 63; X is 77 and Y is 64; X is 77 and Y is 65; X is 77 and Y is 66; X is 77 and Y is 67; X is 77 and Y is 68; X is 77 and Y is 69; X is 77 and Y is 70; X is 77 and Y is 71; X is 77 and Y is 72; X is 77 and Y is 73; X is 77 and Y is 74; X is 77 and Y is 75; X is 77 and Y is 76; X is 77 and Y is 77; X is 77 and Y is 78; X is 77 and Y is 79; X is 77 and is 80; X is 77 and Y is 81; X is 77 and Y is 82; X is 77 and Y is 83; X is 77 and Y is 84; X is 77 and Y is 85; X is 77 and Y is 86; X is 77 and Y is 87; X is 77 and Y is 88; X is 77 and Y is 89; X is 77 and Y is 90; X is 77 and Y is 91; X is 77 and Y is 92; X is 77 and Y is 93; X is 77 and Y is 94; X is 77 and Y is 95; X is 77 and Y is 96; X is 77 and Y is 97; X is 77 and Y is 98; X is 77 and Y is 99; X is 77 and Y is 100; X is 77 and Y is 101; X is 77 and Y is 102; X is 77 and Y is 103; X is 77 and Y is 104; X is 77 and Y is 105; X is 77 and Y is 106; X is 77 and Y is 107; X is 77 and Y is 108; X is 77 and Y is 109; X is 77 and Y is 110; X is 77 and Y is 111; X is 77 and Y is 112; X is 77 and Y is 113; X is 77 and Y is 114; X is 77 and Y is 115; X is 77 and Y is 116; X is 77 and Y is 117; X is 77 and Y is 118; X is 77 and Y is 119; X is 77 and Y is 120; X is 77 and Y is 121; X is 77 and Y is 122; X is 77 and Y is 123; X is 77 and Y is 124; X is 77 and Y is 125; X is 77 and Y is 126; X is 77 and Y is 127; X is 77 and Y is 128; X is 77 and Y is 129; X is 77 and Y is 130; X is 77 and Y is 131; X is 77 and Y is 132; X is 77 and Y is 133; X is 77 and Y is 134; X is 77 and Y is 135; X is 77 and Y is 136; X is 77 and Y is 137; X is 77 and Y is 138; X is 77 and Y is 139; X is 77 and Y is 140; X is 77 and Y is 141; X is 77 and Y is 142; X is 77 and Y is 143; X is 77 and Y is 144; X is 77 and Y is 145; X is 77 and Y is 146; X is 77 and Y is 147; X is 77 and Y is 148; X is 77 and Y is 149; X is 77 and Y is 150; X is 77 and Y is 151; X is 77 and Y is 152; X is 77 and Y is 153; X is 77 and Y is 154; X is 77 and Y is 155; X is 77 and Y is 156; X is 77 and Y is 157; X is 77 and Y is 158; X is 77 and Y is 159; X is 77 and Y is 160; X is 77 and Y is 161; X is 77 and Y is 162; X is 77 and Y is 163; X is 77 and Y is 164; X is 77 and Y is 165; X is 77 and Y is 166; X is 77 and Y is 167; X is 77 and Y is 168; X is 77 and Y is 169; X is 77 and Y is 170; X is 77 and Y is 171; X is 77 and Y is 172; X is 77 and Y is 173; X is 77 and Y is 174; X is 77 and Y is 175; X is 77 and Y is 176; X is 77 and Y is 177; X is 77 and Y is 178; X is 77 and Y is 179; X is 77 and Y is 180; X is 77 and Y is 181; X is 77 and Y is 182; X is 77 and Y is 183; X is 77 and Y is 184; X is 77 and Y is 185; X is 77 and Y is 186;

X is 78 and Y is 1; X is 78 and Y is 2; X is 78 and Y is 3; X is 78 and Y is 4; X is 78 and Y is 5; X is 78 and Y is 6; X is 78 and Y is 7; X is 78 and Y is 8; X is 78 and Y is 9; X is 78 and Y is 10; X is 78 and Y is 11; X is 78 and Y is 12; X is 78 and Y is 13; X is 78 and Y is 14; X is 78 and Y is 15; X is 78 and Y is 16; X is 78 and Y is 17; X is 78 and Y is 18; X is 78 and Y is 19; X is 78 and Y is 20; X is 78 and Y is 21; X is 78 and Y is 22; X is 78 and Y is 23; X is 78 and Y is 24; X is 78 and Y is 25; X is 78 and Y is 26; X is 78 and Y is 27; X is 78 and Y is 28; X is 78 and Y is 29; X is 78 and Y is 30; X is 78 and Y is 31; X is 78 and Y is 32; X is 78 and Y is 33; X is 78 and Y is 34; X is 78 and Y is 35; X is 78 and Y is 36; X is 78 and Y is 37; X is 78 and Y is 38; X is 78 and Y is 39; X is 78 and Y is 40; X is 78 and Y is 41; X is 78 and Y is 42; X is 78 and Y is 43; X is 78 and Y is 44; X is 78 and Y is 45; X is 78 and Y is 46; X is 78 and Y is 47; X is 78 and Y is 48; X is 78 and Y is 49; X is 78 and Y is 50; X is 78 and Y is 51; X is 78 and Y is 52; X is 78 and Y is 53; X is 78 and Y is 54; X is 78 and Y is 55; X is 78 and Y is 56; X is 78 and Y is 57; X is 78 and Y is 58; X is 78 and Y is 59; X is 78 and Y is 60; X is 78 and Y is 61; X is 78 and Y is 62; X is 78 and Y is 63; X is 78 and Y is 64; X is 78 and Y is 65; X is 78 and Y is 66; X is 78 and Y is 67; X is 78 and Y is 68; X is 78 and Y is 69; X is 78 and Y is 70; X is 78 and Y is 71; X is 78 and Y is 72; X is 78 and Y is 73; X is 78 and Y is 74; X is 78 and Y is 75; X is 78 and Y is 76; X is 78 and Y is 77; X is 78 and Y is 78; X is 78 and Y is 79; X is 78 and Y is 80; X is 78 and Y is 81; X is 78 and Y is 82; X is 78 and Y is 83; X is 78 and Y is 84; X is 78 and Y is 85; X is 78 and Y is 86; X is 78 and Y is 87; X is 78 and Y is 88; X is 78 and Y is 89; X is 78 and Y is 90; X is 78 and Y is 91; X is 78 and Y is 92; X is 78 and Y is 93; X is 78 and Y is 94; X is 78 and Y is 95; X is 78 and Y is 96; X is 78 and Y is 97; X is 78 and Y is 98; X is 78 and Y is 99; X is 78 and Y is 100; X is 78 and Y is 101; X is 78 and Y is 102; X is 78 and Y is 103; X is 78 and Y is 104; X is 78 and Y is 105; X is 78 and Y is 106; X is 78 and Y is 107; X is 78 and Y is 108; X is 78 and Y is 109; X is 78 and Y is 110; X is 78 and Y is 111; X is 78 and Y is 112; X is 78 and Y is 113; X is 78 and Y is 114; X is 78 and Y is 115; X is 78 and Y is 116; X is 78 and Y is 117; X is 78 and Y is 118; X is 78 and Y is 119; X is 78 and Y is 120; X is 78 and Y is 121; X is 78 and Y is 122; X is 78 and Y is 123; X is 78 and Y is 124; X is 78 and Y is 125; X is 78 and Y is 126; X is 78 and Y is 127; X is 78 and Y is 128; X is 78 and Y is 129; X is 78 and Y is 130; X is 78 and Y is 131; X is 78 and Y is 132; X is 78 and Y is 133; X is 78 and Y is 134; X is 78 and Y is 135; X is 78 and Y is 136; X is 78 and Y is 137; X is 78 and Y is 138; X is 78 and Y is 139; X is 78 and Y is 140; X is 78 and Y is 141; X is 78 and Y is 142; X is 78 and Y is 143; X is 78 and Y is 144; X is 78 and Y is 145; X is 78 and Y is 146; X is 78 and Y is 147; X is 78 and Y is 148; X is 78 and Y is 149; X is 78 and Y is 150; X is 78 and Y is 151; X is 78 and Y is 152; X is 78 and Y is 153; X is 78 and Y is 154; X is 78 and Y is 155; X is 78 and Y is 156; X is 78 and Y is 157; X is 78 and Y is 158; X is 78 and Y is 159; X is 78 and Y is 160; X is 78 and Y is 161; X is 78 and Y is 162; X is 78 and Y is 163; X is 78 and Y is 164; X is 78 and Y is 165; X is 78 and Y is 166; X is 78 and Y is 167; X is 78 and Y is 168; X is 78 and Y is 169; X is 78 and Y is 170; X is 78 and Y is 171; X is 78 and Y is 172; X is 78 and Y is 173; X is 78 and Y is 174; X is 78 and Y is 175; X is 78 and Y is 176; X is 78 and Y is 177; X is 78 and Y is 178; X is 78 and Y is 179; X is 78 and Y is 180; X is 78 and Y is 181; X is 78 and Y is 182; X is 78 and Y is 183; X is 78 and Y is 184; X is 78 and Y is 185; X is 78 and Y is 186;

X is 79 and Y is 1; X is 79 and Y is 2; X is 79 and Y is 3; X is 79 and Y is 4; X is 79 and Y is 5; X is 79 and Y is 6; X is 79 and Y is 7; X is 79 and Y is 8; X is 79 and Y is 9; X is 79 and Y is 10; X is 79 and Y is 11; X is 79 and Y is 12; X is 79 and Y is 13; X is 79 and Y is 14; X is 79 and Y is 15; X is 79 and Y is 16; X is 79 and Y is 17; X is 79 and Y is 18; X is 79 and Y is 19; X is 79 and Y is 20; X is 79 and Y is 21; X is 79 and Y is 22; X is 79 and Y is 23; X is 79 and Y is 24; X is 79 and Y is 25; X is 79 and Y is 26; X is 79 and Y is 27; X is 79 and Y is 28; X is 79 and Y is 29; X is 79 and Y is 30; X is 79 and Y is 31; X is 79 and Y is 32; X is 79 and Y is 33; X is 79 and Y is 34; X is 79 and Y is 35; X is 79 and Y is 36; X is 79 and Y is 37; X is 79 and Y is 38; X is 79 and Y is 39; X is 79 and Y is 40; X is 79 and Y is 41; X is 79 and Y is 42; X is 79 and Y is 43; X is 79 and Y is 44; X is 79 and Y is 45; X is 79 and Y is 46; X is 79 and Y is 47; X is 79 and Y is 48; X is 79 and Y is 49; X is 79 and Y is 50; X is 79 and Y is 51; X is 79 and Y is 52; X is 79 and Y is 53; X is 79 and Y is 54; X is 79 and Y is 55; X is 79 and Y is 56; X is 79 and Y is 57; X is 79 and Y is 58; X is 79 and Y is 59; X is 79 and Y is 60; X is 79 and Y is 61; X is 79 and Y is 62; X is 79 and Y is 63; X is 79 and Y is 64; X is 79 and Y is 65; X is 79 and Y is 66; X is 79 and Y is 67; X is 79 and Y is 68; X is 79 and Y is 69; X is 79 and Y is 70; X is 79 and Y is 71; X is 79 and Y is 72; X is 79 and Y is 73; X is 79 and Y is 74; X is 79 and Y is 75; X is 79 and Y is 76; X is 79 and Y is 77; X is 79 and Y is 78; X is 79 and Y is 79; X is 79 and Y is 80; X is 79 and Y is 81; X is 79 and Y is 82; X is 79 and Y is 83; X is 79 and Y is 84; X is 79 and Y is 85; X is 79 and Y is 86; X is 79 and Y is 87; X is 79 and Y is 88; X is 79 and Y is 89; X is 79 and Y is 90; X is 79 and Y is 91; X is 79 and Y is 92; X is 79 and Y is 93; X is 79 and Y is 94; X is 79 and Y is 95; X is 79 and Y is 96; X is 79 and Y is 97; X is 79 and Y is 98; X is 79 and Y is 99; X is 79 and Y is 100; X is 79 and Y is 101; X is 79 and Y is 102; X is 79 and Y is 103; X is 79 and Y is 104; X is 79 and Y is 105; X is 79 and Y is 106; X is 79 and Y is 107; X is 79 and Y is 108; X is 79 and Y is 109; X is 79 and Y is 110; X is 79 and Y is 111; X is 79 and Y is 112; X is 79 and Y is 113; X is 79 and Y is 114; X is 79 and Y is 115; X is 79 and Y is 116; X is 79 and Y is 117; X is 79 and Y is 118; X is 79 and Y is 119; X is 79 and Y is 120; X is 79 and Y is 121; X is 79 and Y is 122; X is 79 and Y is 123; X is 79 and Y is 124; X is 79 and Y is 125; X is 79 and Y is 126; X is 79 and Y is 127; X is 79 and Y is 128; X is 79 and Y is 129; X is 79 and Y is 130; X is 79 and Y is 131; X is 79 and Y is 132; X is 79 and Y is 133; X is 79 and Y is 134; X is 79 and Y is 135; X is 79 and Y is 136; X is 79 and Y is 137; X is 79 and Y is 138; X is 79 and Y is 139; X is 79 and Y is 140; X is 79 and Y is 141; X is 79 and Y is 142; X is 79 and Y is 143; X is 79 and Y is 144; X is 79 and Y is 145; X is 79 and Y is 146; X is 79 and Y is 147; X is 79 and Y is 148; X is 79 and Y is 149; X is 79 and Y is 150; X is 79 and Y is 151; X is 79 and Y is 152; X is 79 and Y is 153; X is 79 and Y is 154; X is 79 and Y is 155; X is 79 and Y is 156; X is 79 and Y is 157; X is 79 and Y is 158; X is 79 and Y is 159; X is 79 and Y is 160; X is 79 and Y is 161; X is 79 and Y is 162; X is 79 and Y is 163; X is 79 and Y is 164; X is 79 and Y is 165; X is 79 and Y is 166; X is 79 and Y is 167; X is 79 and Y is 168; X is 79 and Y is 169; X is 79 and Y is 170; X is 79 and Y is 171; X is 79 and Y is 172; X is 79 and Y is 173; X is 79 and Y is 174; X is 79 and Y is 175; X is 79 and Y is 176; X is 79 and Y is 177; X is 79 and Y is 178; X is 79 and Y is 179; X is 79 and Y is 180; X is 79 and Y is 181; X is 79 and Y is 182; X is 79 and Y is 183; X is 79 and Y is 184; X is 79 and Y is 185; X is 79 and Y is 186; X is 80 and Y is 1; X is 80 and Y is 2; X is 80 and Y is 3; X is 80 and Y is 4; X is 80 and Y is 5; X is 80 and Y is 6; X is 80 and Y is 7; X is 80 and Y is 8; X is 80 and Y is 9; X is 80 and Y is 10; X is 80 and Y is 11; X is 80 and Y is 12; X is 80 and Y is 13; X is 80 and Y is 14; X is 80 and Y is 15; X is 80 and Y is 16; X is 80 and Y is 17; X is 80 and Y is 18; X is 80 and Y is 19; X is 80 and Y is 20; X is 80 and Y is 21; X is 80 and Y is 22; X is 80 and Y is 23; X is 80 and Y is 24; X is 80 and Y is 25; X is 80 and Y is 26; X is 80 and Y is 27; X is 80 and Y is 28; X is 80 and Y is 29; X is 80 and Y is 30; X is 80 and Y is 31; X is 80 and Y is 32; X is 80 and Y is 33; X is 80 and Y is 34; X is 80 and Y is 35; X is 80 and Y is 36; X is 80 and Y is 37; X is 80 and Y is 38; X is 80 and Y is 39; X is 80 and Y is 40; X is 80 and Y is 41; X is 80 and Y is 42; X is 80 and Y is 43; X is 80 and Y is 44; X is 80 and Y is 45; X is 80 and Y is 46; X is 80 and Y is 47; X is 80 and Y is 48; X is 80 and Y is 49; X is 80 and Y is 50; X is 80 and Y is 51; X is 80 and Y is 52; X is 80 and Y is 53; X is 80 and Y is 54; X is 80 and Y is 55; X is 80 and Y is 56; X is 80 and Y is 57; X is 80 and Y is 58; X is 80 and Y is 59; X is 80 and Y is 60; X is 80 and Y is 61; X is 80 and Y is 62; X is 80 and Y is 63; X is 80 and Y is 64; X is 80 and Y is 65; X is 80 and Y is 66; X is 80 and Y is 67; X is 80 and Y is 68; X is 80 and Y is 69; X is 80 and Y is 70; X is 80 and Y is 71; X is 80 and Y is 72; X is 80 and Y is 73; X is 80 and Y is 74; X is 80 and Y is 75; X is 80 and Y is 76; X is 80 and Y is 77; X is 80 and Y is 78; X is 80 and Y is 79; X is 80 and Y is 80; X is 80 and Y is 81; X is 80 and Y is 82; X is 80 and Y is 83; X is 80 and Y is 84; X is 80 and Y is 85; X is 80 and Y is 86; X is 80 and Y is 87; X is 80 and Y is 88; X is 80 and Y is 89; X is 80 and Y is 90; X is 80 and Y is 91; X is 80 and Y is 92; X is 80 and Y is 93; X is 80 and Y is 94; X is 80 and Y is 95; X is 80 and Y is 96; X is 80 and Y is 97; X is 80 and Y is 98; X is 80 and Y is 99; X is 80 and Y is 100; X is 80 and Y is 101; X is 80 and Y is 102; X is 80 and Y is 103; X is 80 and Y is 104; X is 80 and Y is 105; X is 80 and Y is 106; X is 80 and Y is 107; X is 80 and Y is 108; X is 80 and Y is 109; X is 80 and Y is 110; X is 80 and Y is 111; X is 80 and Y is 112; X is 80 and Y is 113; X is 80 and Y is 114; X is 80 and Y is 115; X is 80 and Y is 116; X is 80 and Y is 117; X is 80 and Y is 118; X is 80 and Y is 119; X is 80 and Y is 120; X is 80 and Y is 121; X is 80 and Y is 122; X is 80 and Y is 123; X is 80 and Y is 124; X is 80 and Y is 125; X is 80 and Y is 126; X is 80 and Y is 127; X is 80 and Y is 128; X is 80 and Y is 129; X is 80 and Y is 130; X is 80 and Y is 131; X is 80 and Y is 132; X is 80 and Y is 133; X is 80 and Y is 134; X is 80 and Y is 135; X is 80 and Y is 136; X is 80 and Y is 137; X is 80 and Y is 138; X is 80 and Y is 139; X is 80 and Y is 140; X is 80 and Y is 141; X is 80 and Y is 142; X is 80 and Y is 143; X is 80 and Y is 144; X is 80 and Y is 145; X is 80 and Y is 146; X is 80 and Y is 147; X is 80 and Y is 148; X is 80 and Y is 149; X is 80 and Y is 150; X is 80 and Y is 151; X is 80 and Y is 152; X is 80 and Y is 153; X is 80 and Y is 154; X is 80 and Y is 155; X is 80 and Y is 156; X is 80 and Y is 157; X is 80 and Y is 158; X is 80 and Y is 159; X is 80 and Y is 160; X is 80 and Y is 161; X is 80 and Y is 162; X is 80 and Y is 163; X is 80 and Y is 164; X is 80 and Y is 165; X is 80 and Y is 166; X is 80 and Y is 167; X is 80 and Y is 168; X is 80 and Y is 169; X is 80 and Y is 170; X is 80 and Y is 171; X is 80 and Y is 172; X is 80 and Y is 173; X is 80 and Y is 174; X is 80 and Y is 175; X is 80 and Y is 176; X is 80 and Y is 177; X is 80 and Y is 178; X is 80 and Y is 179; X is 80 and Y is 180; X is 80 and Y is 181; X is 80 and Y is 182; X is 80 and Y is 183; X is 80 and Y is 184; X is 80 and Y is 185; X is 80 and Y is 186; X is 81 and Y is 1; X is 81 and Y is 2; X is 81 and Y is 3; X is 81 and Y is 4; X is 81 ma Y is 5; X is 81 and Y is 6; X is 81 and Y is 7; X is 81 and Y is 8; X is 81 and Y is 9; X is 81 and Y is 10; X is 81 and Y is 11; X is 81 and Y is 12; X is 81 and Y is 13; X is 81 and Y is 14; X is 81 and Y is 15; X is 81 and Y is 16; X is 81 and Y is 17; X is 81 and Y is 18; X is 81 and Y is 19; X is 81 and Y is 20; X is 81 and Y is 21; X is 81 and Y is 22; X is 81 and Y is 23; X is 81 and Y is 24; X is 81 and Y is 25; X is 81 and Y is 26; X is 81 and Y is 27; X is 81 and Y is 28; X is 81 and Y is 29; X is 81 and Y is 30; X is 81 and Y is 31; X is 81 and Y is 32; X is 81 and Y is 33; X is 81 and Y is 34; X is 81 and Y is 35; X is 81 and Y is 36; X is 81 and Y is 37; X is 81 and Y is 38; X is 81 and Y is 39; X is 81 and Y is 40; X is 81 and Y is 41; X is 81 and Y is 42; X is 81 and Y is 43; X is 81 and Y is 44; X is 81 and Y is 45; X is 81 and Y is 46; X is 81 and Y is 47; X is 81 and Y is 48; X is 81 and Y is 49; X is 81 and Y is 50; X is 81 and Y is 51; X is 81 and Y is 52; X is 81 and Y is 53; X is 81 and Y is 54; X is 81 and Y is 55; X is 81 and Y is 56; X is 81 and Y is 57; X is 81 and Y is 58; X is 81 and Y is 59; X is 81 and Y is 60; X is 81 and Y is 61; X is 81 and Y is 62; X is 81 and Y is 63; X is 81 and Y is 64; X is 81 and Y is 65; X is 81 and Y is 66; X is 81 and Y is 67; X is 81 and Y is 68; X is 81 and Y is 69; X is 81 and Y is 70; X is 81 and Y is 71; X is 81 and Y is 72; X is 81 and Y is 73; X is 81 and Y is 74; X is 81 and Y is 75; X is 81 and Y is 76; X is 81 and Y is 77; X is 81 and Y is 78; X is 81 and Y is 79; X is 81 and Y is 80; X is 81 and Y is 81; X is 81 and Y is 82; X is 81 and Y is 83; X is 81 and Y is 84; X is 81 and Y is 85; X is 81 and Y is 86; X is 81 and Y is 87; X is 81 and Y is 88; X is 81 and Y is 89; X is 81 and Y is 90; X is 81 and Y is 91; X is 81 and Y is 92; X is 81 and Y is 93; X is 81 and Y is 94; X is 81 and Y is 95; X is 81 and Y is 96; X is 81 and Y is 97; X is 81 and Y is 98; X is 81 and Y is 99; X is 81 and Y is 100; X is 81 and Y is 101; X is 81 and Y is 102; X is 81 and Y is 103; X is 81 and Y is 104; X is 81 and Y is 105; X is 81 and Y is 106; X is 81 and Y is 107; X is 81 and Y is 108; X is 81 and Y is 109; X is 81 and Y is 110; X is 81 and Y is 111; X is 81 and Y is 112; X is 81 and Y is 113; X is 81 and Y is 114; X is 81 and Y is 115; X is 81 and Y is 116; X is 81 and Y is 117; X is 81 and Y is 118; X is 81 and Y is 119; X is 81 and Y is 120; X is 81 and Y is 121; X is 81 and Y is 122; X is 81 and Y is 123; X is 81 and Y is 124; X is 81 and Y is 125; X is 81 and Y is 126; X is 81 and Y is 127; X is 81 and Y is 128; X is 81 and Y is 129; X is 81 and Y is 130; X is 81 and Y is 131; X is 81 and Y is 132; X is 81 and Y is 133; X is 81 and Y is 134; X is 81 and Y is 135; X is 81 and Y is 136; X is 81 and Y is 137; X is 81 and Y is 138; X is 81 and Y is 139; X is 81 and Y is 140; X is 81 and Y is 141; X is 81 and Y is 142; X is 81 and Y is 143; X is 81 and Y is 144; X is 81 and Y is 145; X is 81 and Y is 146; X is 81 and Y is 147; X is 81 and Y is 148; X is 81 and Y is 149; X is 81 and Y is 150; X is 81 and Y is 151; X is 81 and Y is 152; X is 81 and Y is 153; X is 81 and Y is 154; X is 81 and Y is 155; X is 81 and Y is 156; X is 81 and Y is 157; X is 81 and Y is 158; X is 81 and Y is 159; X is 81 and Y is 160; X is 81 and Y is 161; X is 81 and Y is 162; X is 81 and Y is 163; X is 81 and Y is 164; X is 81 and Y is 165; X is 81 and Y is 166; X is 81 and Y is 167; X is 81 and Y is 168; X is 81 and Y is 169; X is 81 and Y is 170; X is 81 and Y is 171; X is 81 and Y is 172; X is 81 and Y is 173; X is 81 and Y is 174; X is 81 and Y is 175; X is 81 and Y is 176; X is 81 and Y is 177; X is 81 and Y is 178; X is 81 and Y is 179; X is 81 and Y is 180; X is 81 and Y is 181; X is 81 and Y is 182; X is 81 and Y is 183; X is 81 and Y is 184; X is 81 and Y is 185; X is 81 and Y is 186; X is 82 and Y is 1; X is 82 and Y is 2; X is 82 and Y is 3; X is 82 and Y is 4; X is 82 and Y is 5; X is 82 and Y is 6; X is 82 and Y is 7; X is 82 and Y is 8; X is 82 and Y is 9; X is 82 and Y is 10; X is 82 and Y is 11; X is 82 and Y is 12; X is 82 and Y is 13; X is 82 and Y is 14; X is 82 and Y is 15; X is 82 and Y is 16; X is 82 and Y is 17; X is 82 and Y is 18; X is 82 and Y is 19; X is 82 and Y is 20; X is 82 and Y is 21; X is 82 and Y is 22; X is 82 and Y is 23; X is 82 and Y is 24; X is 82 and Y is 25; X is 82 and Y is 26; X is 82 and Y is 27; X is 82 and Y is 28; X is 82 and Y is 29; X is 82 and Y is 30; X is 82 and Y is 31; X is 82 and Y is 32; X is 82 and Y is 33; X is 82 and Y is 34; X is 82 and Y is 35; X is 82 and Y is 36; X is 82 and Y is 37; X is 82 and Y is 38; X is 82 and Y is 39; X is 82 and Y is 40; X is 82 and Y is 41; X is 82 and Y is 42; X is 82 and Y is 43; X is 82 and Y is 44; X is 82 and Y is 45; X is 82 and Y is 46; X is 82 and Y is 47; X is 82 and Y is 48; X is 82 and Y is 49; X is 82 and Y is 50; X is 82 and Y is 51; X is 82 and Y is 52; X is 82 and Y is 53; X is 82 and Y is 54; X is 82 and Y is 55; X is 82 and Y is 56; X is 82 and Y is 57; X is 82 and Y is 58; X is 82 and Y is 59; X is 82 and Y is 60; X is 82 and Y is 61; X is 82 and Y is 62; X is 82 and Y is 63; X is 82 and Y is 64; X is 82 and Y is 65; X is 82 and Y is 66; X is 82 and Y is 67; X is 82 and Y is 68; X is 82 and Y is 69; X is 82 and Y is 70; X is 82 and Y is 71; X is 82 and Y is 72; X is 82 and Y is 73; X is 82 and Y is 74; X is 82 and Y is 75; X is 82 and Y is 76; X is 82 and Y is 77; X is 82 and Y is 78; X is 82 and Y is 79; X is 82 and Y is 80; X is 82 and Y is 81; X is 82 and Y is 82; X is 82 and Y is 83; X is 82 and Y is 84; X is 82 and Y is 85; X is 82 and Y is 86; X is 82 and Y is 87; X is 82 and Y is 88; X is 82 and Y is 89; X is 82 and Y is 90; X is 82 and Y is 91; X is 82 and Y is 92; X is 82 and Y is 93; X is 82 and Y is 94; X is 82 and Y is 95; X is 82 and Y is 96; X is 82 and Y is 97; X is 82 and Y is 98; X is 82 and Y is 99; X is 82 and Y is 100; X is 82 and Y is 101; X is 82 and Y is 102; X is 82 and Y is 103; X is 82 and Y is 104; X is 82 and Y is 105; X is 82 and Y is 106; X is 82 and Y is 107; X is 82 and Y is 108; X is 82 and Y is 109; X is 82 and Y is 110; X is 82 and Y is 111; X is 82 and Y is 112; X is 82 and Y is 113; X is 82 and Y is 114; X is 82 and Y is 115; X is 82 and Y is 116; X is 82 and Y is 117; X is 82 and Y is 118; X is 82 and Y is 119; X is 82 and Y is 120; X is 82 and Y is 121; X is 82 and Y is 122; X is 82 and Y is 123; X is 82 and Y is 124; X is 82 and Y is 125; X is 82 and Y is 126; X is 82 and Y is 127; X is 82 and Y is 128; X is 82 and Y is 129; X is 82 and Y is 130; X is 82 and Y is 131; X is 82 and Y is 132; X is 82 and Y is 133; X is 82 and Y is 134; X is 82 and Y is 135; X is 82 and Y is 136; X is 82 and Y is 137; X is 82 and Y is 138; X is 82 and Y is 139; X is 82 and Y is 140; X is 82 and Y is 141; X is 82 and Y is 142; X is 82 and Y is 143; X is 82 and Y is 144; X is 82 and Y is 145; X is 82 and Y is 146; X is 82 and Y is 147; X is 82 and Y is 148; X is 82 and Y is 149; X is 82 and Y is 150; X is 82 and Y is 151; X is 82 and Y is 152; X is 82 and Y is 153; X is 82 and Y is 154; X is 82 and Y is 155; X is 82 and Y is 156; X is 82 and Y is 157; X is 82 and Y is 158; X is 82 and Y is 159; X is 82 and Y is 160; X is 82 and Y is 161; X is 82 and Y is 162; X is 82 and Y is 163; X is 82 and Y is 164; X is 82 and Y is 165; X is 82 and Y is 166; X is 82 and Y is 167; X is 82 and Y is 168; X is 82 and Y is 169; X is 82 and Y is 170; X is 82 and Y is 171; X is 82 and Y is 172; X is 82 and Y is 173; X is 82 and Y is 174; X is 82 and Y is 175; X is 82 and Y is 176; X is 82 and Y is 177; X is 82 and Y is 178; X is 82 and Y is 179; X is 82 and Y is 180; X is 82 and Y is 181; X is 82 and Y is 182; X is 82 and Y is 183; X is 82 and Y is 184; X is 82 and Y is 185; X is 82 and Y is 186; X is 83 and Y is 1; X is 83 and Y is 2; X is 83 and Y is 3; X is 83 and Y is 4; X is 83 and Y is 5; X is 83 and Y is 6; X is 83 and Y is 7; X is 83 and Y is 8; X is 83 and Y is 9; X is 83 and Y is 10; X is 83 and Y is 11; X is 83 and Y is 12; X is 83 and Y is 13; X is 83 and Y is 14; X is 83 and Y is 15; X is 83 and Y is 16; X is 83 and Y is 17; X is 83 and Y is 18; X is 83 and Y is 19; X is 83 and Y is 20; X is 83 and Y is 21; X is 83 and Y is 22; X is 83 and Y is 23; X is 83 and Y is 24; X is 83 and Y is 25; X is 83 and Y is 26; X is 83 and Y is 27; X is 83 and Y is 28; X is 83 and Y is 29; X is 83 and Y is 30; X is 83 and Y is 31; X is 83 and Y is 32; X is 83 and Y is 33; X is 83 and Y is 34; X is 83 and Y is 35; X is 83 and Y is 36; X is 83 and Y is 37; X is 83 and Y is 38; X is 83 and Y is 39; X is 83 and Y is 40; X is 83 and Y is 41; X is 83 and Y is 42; X is 83 and Y is 43; X is 83 and Y is 44; X is 83 and Y is 45; X is 83 and Y is 46; X is 83 and Y is 47; X is 83 and Y is 48; X is 83 and Y is 49; X is 83 and Y is 50; X is 83 and Y is 51; X is 83 and Y is 52; X is 83 and Y is 53; X is 83 and Y is 54; X is 83 and Y is 55; X is 83 and Y is 56; X is 83 and Y is 57; X is 83 and Y is 58; X is 83 and Y is 59; X is 83 and Y is 60; X is 83 and Y is 61; X is 83 and Y is 62; X is 83 and Y is 63; X is 83 and Y is 64; X is 83 and Y is 65; X is 83 and Y is 66; X is 83 and Y is 67; X is 83 and Y is 68; X is 83 and Y is 69; X is 83 and Y is 70; X is 83 and Y is 71; X is 83 and Y is 72; X is 83 and Y is 73; X is 83 and Y is 74; X is 83 and Y is 75; X is 83 and Y is 76; X is 83 and Y is 77; X is 83 and Y is 78; X is 83 and Y is 79; X is 83 and Y is 80; X is 83 and Y is 81; X is 83 and Y is 82; X is 83 and Y is 83; X is 83 and Y is 84; X is 83 and Y is 85; X is 83 and Y is 86; X is 83 and Y is 87; X is 83 and Y is 88; X is 83 and Y is 89; X is 83 and Y is 90; X is 83 and Y is 91; X is 83 and Y is 92; X is 83 and Y is 93; X is 83 and Y is 94; X is 83 and Y is 95; X is 83 and Y is 96; X is 83 and Y is 97; X is 83 and Y is 98; X is 83 and Y is 99; X is 83 and Y is 100; X is 83 and Y is 101; X is 83 and Y is 102; X is 83 and Y is 103; X is 83 and Y is 104; X is 83 and Y is 105; X is 83 and Y is 106; X is 83 and Y is 107; X is 83 and Y is 108; X is 83 and Y is 109; X is 83 and Y is 110; X is 83 and Y is 111; X is 83 and Y is 112; X is 83 and Y is 113; X is 83 and Y is 114; X is 83 and Y is 115; X is 83 and Y is 116; X is 83 and Y is 117; X is 83 and Y is 118; X is 83 and Y is 119; X is 83 and Y is 120; X is 83 and Y is 121; X is 83 and Y is 122; X is 83 and Y is 123; X is 83 and Y is 124; X is 83 and Y is 125; X is 83 and Y is 126; X is 83 and Y is 127; X is 83 and Y is 128; X is 83 and Y is 129; X is 83 and Y is 130; X is 83 and Y is 131; X is 83 and Y is 132; X is 83 and Y is 133; X is 83 and Y is 134; X is 83 and Y is 135; X is 83 and Y is 136; X is 83 and Y is 137; X is 83 and Y is 138; X is 83 and Y is 139; X is 83 and Y is 140; X is 83 and Y is 141; X is 83 and Y is 142; X is 83 and Y is 143; X is 83 and Y is 144; X is 83 and Y is 145; X is 83 and Y is 146; X is 83 and Y is 147; X is 83 and Y is 148; X is 83 and Y is 149; X is 83 and Y is 150; X is 83 and Y is 151; X is 83 and Y is 152; X is 83 and Y is 153; X is 83 and Y is 154; X is 83 and Y is 155; X is 83 and Y is 156; X is 83 and Y is 157; X is 83 and Y is 158; X is 83 and Y is 159; X is 83 and Y is 160; X is 83 and Y is 161; X is 83 and Y is 162; X is 83 and Y is 163; X is 83 and Y is 164; X is 83 and Y is 165; X is 83 and Y is 166; X is 83 and Y is 167; X is 83 and Y is 168; X is 83 and Y is 169; X is 83 and Y is 170; X is 83 and Y is 171; X is 83 and Y is 172; X is 83 and Y is 173; X is 83 and Y is 174; X is 83 and Y is 175; X is 83 and Y is 176; X is 83 and Y is 177; X is 83 and Y is 178; X is 83 and Y is 179; X is 83 and Y is 180; X is 83 and Y is 181; X is 83 and Y is 182; X is 83 and Y is 183; X is 83 and Y is 184; X is 83 and Y is 185; X is 83 and Y is 186; X is 84 and Y is 1; X is 84 and Y is 2; X is 84 and Y is 3; X is 84 and Y is 4; X is 84 and Y is 5; X is 84 and Y is 6; X is 84 and Y is 7; X is 84 and Y is 8; X is 84 and Y is 9; X is 84 and Y is 10; X is 84 and Y is 11; X is 84 and Y is 12; X is 84 and Y is 13; X is 84 and Y is 14; X is 84 and Y is 15; X is 84 and Y is 16; X is 84 and Y is 17; X is 84 and Y is 18; X is 84 and Y is 19; X is 84 and Y is 20; X is 84 and Y is 21; X is 84 and Y is 22; X is 84 and Y is 23; X is 84 and Y is 24; X is 84 and Y is 25; X is 84 and Y is 26; X is 84 and Y is 27; X is 84 and Y is 28; X is 84 and Y is 29; X is 84 and Y is 30; X is 84 and Y is 31; X is 84 and Y is 32; X is 84 and Y is 33; X is 84 and Y is 34; X is 84 and Y is 35; X is 84 and Y is 36; X is 84 and Y is 37; X is 84 and Y is 38; X is 84 and Y is 39; X is 84 and Y is 40; X is 84 and Y is 41; X is 84 and Y is 42; X is 84 and Y is 43; is 84 and Y is 44; X is 84 and Y is 45; is 84 and Y is 46; X is 84 and Y is 47; X is 84 and Y is 48; X is 84 and Y is 49; X is 84 and Y is 50; X is 84 and Y is 51; X is 84 and Y is 52; X is 84 and Y is 53; X is 84 and Y is 54; X is 84 and Y is 55; X is 84 and Y is 56; X is 84 and Y is 57; X is 84 and Y is 58; X is 84 and Y is 59; X is 84 and Y is 60; X is 84 and Y is 61; X is 84 and Y is 62; X is 84 and Y is 63; X is 84 and Y is 64; X is 84 and Y is 65; X is 84 and Y is 66; X is 84 and Y is 67; X is 84 and Y is 68; X is 84 and Y is 69; X is 84 and Y is 70; X is 84 and Y is 71; X is 84 and Y is 72; X is 84 and Y is 73; X is 84 and Y is 74; X is 84 and Y is 75; X is 84 and Y is 76; X is 84 and Y is 77; X is 84 and Y is 78; X is 84 and Y is 79; X is 84 and Y is 80; X is 84 and Y is 81; X is 84 and Y is 82; X is 84 and Y is 83; X is 84 and Y is 84; X is 84 and Y is 85; X is 84 and Y is 86; X is 84 and Y is 87; X is 84 and Y is 88; X is 84 and Y is 89; X is 84 and Y is 90; X is 84 and Y is 91; X is 84 and Y is 92; X is 84 and Y is 93; X is 84 and Y is 94; X is 84 and Y is 95; X is 84 and Y is 96; X is 84 and Y is 97; X is 84 and Y is 98; X is 84 and Y is 99; X is 84 and Y is 100; X is 84 and Y is 101; X is 84 and Y is 102; X is 84 and Y is 103; X is 84 and Y is 104; X is 84 and Y is 105; X is 84 and Y is 106; X is 84 and Y is 107; X is 84 and Y is 108; X is 84 and Y is 109; X is 84 and Y is 110; X is 84 and Y is 111; X is 84 and Y is 112; X is 84 and Y is 113; X is 84 and Y is 114; X is 84 and Y is 115; X is 84 and Y is 116; X is 84 and Y is 117; X is 84 and Y is 118; X is 84 and Y is 119; X is 84 and Y is 120; X is 84 and Y is 121; X is 84 and Y is 122; X is 84 and Y is 123; X is 84 and Y is 124; X is 84 and Y is 125; X is 84 and Y is 126; X is 84 and Y is 127; X is 84 and Y is 128; X is 84 and Y is 129; X is 84 and Y is 130; X is 84 and Y is 131; X is 84 and Y is 132; X is 84 and Y is 133; X is 84 and Y is 134; X is 84 and Y is 135; X is 84 and Y is 136; X is 84 and Y is 137; X is 84 and Y is 138; X is 84 and Y is 139; X is 84 and Y is 140; X is 84 and Y is 141; X is 84 and Y is 142; X is 84 and Y is 143; X is 84 and Y is 144; X is 84 and Y is 145; X is 84 and Y is 146; X is 84 and Y is 147; X is 84 and Y is 148; X is 84 and Y is 149; X is 84 and Y is 150; X is 84 and Y is 151; X is 84 and Y is 152; X is 84 and Y is 153; X is 84 and Y is 154; X is 84 and Y is 155; X is 84 and Y is 156; X is 84 and Y is 157; X is 84 and Y is 158; X is 84 and Y is 159; X is 84 and Y is 160; X is 84 and Y is 161; X is 84 and Y is 162; X is 84 and Y is 163; X is 84 and Y is 164; X is 84 and Y is 165; X is 84 and Y is 166; X is 84 and Y is 167; X is 84 and Y is 168; X is 84 and Y is 169; X is 84 and Y is 170; X is 84 and Y is 171; X is 84 and Y is 172; X is 84 and Y is 173; X is 84 and Y is 174; X is 84 and Y is 175; X is 84 and Y is 176; X is 84 and Y is 177; X is 84 and Y is 178; X is 84 and Y is 179; X is 84 and Y is 180; X is 84 and Y is 181; X is 84 and Y is 182; X is 84 and Y is 183; X is 84 and Y is 184; X is 84 and Y is 185; X is 84 and Y is 186;

X is 85 and Y is 1; X is 85 and Y is 2; X is 85 and Y is 3; X is 85 and Y is 4; X is 85 and Y is 5; X is 85 and Y is 6; X is 85 and Y is 7; X is 85 and Y is 8; X is 85 and Y is 9; X is 85 and Y is 10; X is 85 and Y is 11; X is 85 and Y is 12; X is 85 and Y is 13; X is 85 and Y is 14; X is 85 and Y is 15; X is 85 and Y is 16; X is 85 and Y is 17; X is 85 and Y is 18; X is 85 and Y is 19; X is 85 and Y is 20; X is 85 and Y is 21; X is 85 and Y is 22; X is 85 and Y is 23; X is 85 and Y is 24; X is 85 and Y is 25; X is 85 and Y is 26; X is 85 and Y is 27; X is 85 and Y is 28; X is 85 and Y is 29; X is 85 and Y is 30; X is 85 and Y is 31; X is 85 and Y is 32; X is 85 and Y is 33; X is 85 and Y is 34; X is 85 and Y is 35; X is 85 and Y is 36; X is 85 and Y is 37; X is 85 and Y is 38; X is 85 and Y is 39; X is 85 and Y is 40; X is 85 and Y is 41; X is 85 and Y is 42; X is 85 and Y is 43; X is 85 and Y is 44; X is 85 and Y is 45; X is 85 and Y is 46; X is 85 and Y is 47; X is 85 and Y is 48; X is 85 and Y is 49; X is 85 and Y is 50; X is 85 and Y is 51; X is 85 and Y is 52; X is 85 and Y is 53; X is 85 and Y is 54; X is 85 and Y is 55; X is 85 and y is 56; is 85 and Y is 57; X is 85 and Y is 58; X is 85 and Y is 59; X is 85 and Y is 60; X is 85 and Y is 61; X is 85 and Y is 62; X is 85 and Y is 63; X is 85 and Y is 64; X is 85 and Y is 65; X is 85 and Y is 66; X is 85 and Y is 67; X is 85 and Y is 68; X is 85 and Y is 69; X is 85 and Y is 70; X is 85 and Y is 71; X is 85 and Y is 72; X is 85 and Y is 73; X is 85 and Y is 74; X is 85 and Y is 75; X is 85 and Y is 76; X is 85 and Y is 77; X is 85 and Y is 78; X is 85 and Y is 79; X is 85 and Y is 80; X is 85 and Y is 81; X is 85 and Y is 82; X is 85 and Y is 83; X is 85 and Y is 84; X is 85 and Y is 85; X is 85 and Y is 86; X is 85 and Y is 87; X is 85 and Y is 88; X is 85 and Y is 89; X is 85 and Y is 90; X is 85 and Y is 91; X is 85 and Y is 92; X is 85 and Y is 93; X is 85 and Y is 94; X is 85 and Y is 95; X is 85 and Y is 96; X is 85 and Y is 97; X is 85 and Y is 98; X is 85 and Y is 99; X is 85 and Y is 100; X is 85 and Y is 101; X is 85 and Y is 102; X is 85 and Y is 103; X is 85 and Y is 104; X is 85 and Y is 105; X is 85 and Y is 106; X is 85 and Y is 107; X is 85 and Y is 108; X is 85 and Y is 109; X is 85 and Y is 110; X is 85 and Y is 111; X is 85 and Y is 112; X is 85 and Y is 113; X is 85 and Y is 114; X is 85 and Y is 115; X is 85 and Y is 116; X is 85 and Y is 117; X is 85 and Y is 118; X is 85 and Y is 119; X is 85 and Y is 120; X is 85 and Y is 121; X is 85 and Y is 122; X is 85 and Y is 123; X is 85 and Y is 124; X is 85 and Y is 125; X is 85 and Y is 126; X is 85 and Y is 127; X is 85 and Y is 128; X is 85 and Y is 129; X is 85 and Y is 130; X is 85 and Y is 131; X is 85 and Y is 132; X is 85 and Y is 133; X is 85 and Y is 134; X is 85 and Y is 135; X is 85 and Y is 136; X is 85 and Y is 137; X is 85 and Y is 138; X is 85 and Y is 139; X is 85 and Y is 140; X is 85 and Y is 141; X is 85 and Y is 142; X is 85 and Y is 143; X is 85 and Y is 144; X is 85 and Y is 145; X is 85 and Y is 146; X is R5 and Y is 147; X is 85 and Y is 148; X is 85 and Y is 149; X is 85 and Y is 150; X is 85 and Y is 151; X is 85 and Y is 152; X is 85 and Y is 153; X is 85 and Y is 154; X is 85 and Y is 155; X is 85 and Y is 156; X is 85 and Y is 157; X is 85 and Y is 158; X is 85 and Y is 159; X is 85 and Y is 160; X is 85 and Y is 161; X is 85 and Y is 162; X is 85 and Y is 163; X is 85 and Y is 164; X is 85 and Y is 165; X is 85 and Y is 166; X is 85 and Y is 167; X is 85 and Y is 168; X is 85 and Y is 169; X is 85 and Y is 170; X is 85 and Y is 171; X is 85 and Y is 172; X is 85 and Y is 173; X is 85 and Y is 174; X is 85 and Y is 175; X is 85 and Y is 176; X is 85 and Y is 177; X is 85 and Y is 178; X is 85 and Y is 179; X is 85 and Y is 180; X is 85 and Y is 181; X is 85 and Y is 182; X is 85 and Y is 183; X is 85 and Y is 184; X is 85 and Y is 185; X is 85 and Y is 186;

X is 86 and Y is 1; X is 86 and Y is 2; X is 86 and Y is 3; X is 86 and Y is 4; X is 86 and Y is 5; X is 86 and Y is 6; X is 86 and Y is 7; X is 86 and Y is 8; X is 86 and Y is 9; X is 86 and Y is 10; X is 86 and Y is 11; X is 86 and Y is 12; X is 86 and Y is 13; X is 86 and Y is 14; X is 86 and Y is 15; X is 86 and Y is 16; X is 86 and Y is 17; X is 86 and Y is 18; X is 86 and Y is 19; X is 86 and Y is 20; X is 86 and Y is 21; X is 86 and Y is 22; X is 86 and Y is 23; X is 86 and Y is 24; X is 86 and Y is 25; X is 86 and Y is 26; X is 86 and Y is 27; X is 86 and Y is 28; X is 86 and Y is 29; X is 86 and Y is 30; X is 86 and Y is 31; X is 86 and Y is 32; X is 86 and Y is 33; X is 86 and Y is 34; X is 86 and Y is 35; X is 86 and Y is 36; X is 86 and Y is 37; X is 86 and Y is 38; X is 86 and Y is 39; X is 86 and Y is 40; X is 86 and Y is 41; X is 86 and Y is 42; X is 86 and Y is 43; X is 86 and Y is 44; X is 86 and Y is 45; X is 86 and Y is 46; X is 86 and Y is 47; X is 86 and Y is 48; X is 86 and Y is 49; X is 86 and Y is 50; X is 86 and Y is 51; X is 86 and Y is 52; X is 86 and Y is 53; X is 86 and Y is 54; X is 86 and Y is 55; X is 86 and Y is 56; X is 86 and Y is 57; X is 86 and Y is 58; X is 86 and Y is 59; X is 86 and Y is 60; X is 86 and Y is 61; X is 86 and Y is 62; X is 86 and Y is 63; X is 86 and Y is 64; X is 86 and Y is 65; X is 86 and Y is 66; X is 86 and Y is 67; X is 86 and Y is 68; X is 86 and Y is 69; X is 86 and Y is 70; X is 86 and Y is 71; X is 86 and Y is 72; X is 86 and Y is 73; X is 86 and Y is 74; X is 86 and Y is 75; X is 86 and Y is 76; X is 86 and Y is 77; X is 86 and Y is 78; X is 86 and Y is 79; X is 86 and Y is 80; X is 86 and Y is 81; X is 86 and Y is 82; X is 86 and Y is 83; X is 86 and Y is 84; X is 86 and Y is 85; X is 86 and Y is 86; X is 86 and Y is 87; X is 86 and Y is 88; X is 86 and Y is 89; X is 86 and Y is 90; X is 86 and Y is 91; X is 86 and Y is 92; X is 86 and Y is 93; X is 86 and Y is 94; X is 86 and Y is 95; X is 86 and Y is 96; X is 86 and Y is 97; X is 86 and Y is 98; X is 86 and Y is 99; X is 86 and Y is 100; X is 86 and Y is 101; X is 86 and Y is 102; X is 86 and Y is 103; X is 86 and Y is 104; X is 86 and Y is 105; X is 86 and Y is 106; X is 86 and Y is 107; X is 86 and Y is 108; X is 86 and Y is 109; X is 86 and Y is 110; X is 86 and Y is 111; X is 86 and Y is 112; X is 86 and Y is 113; X is 86 and Y is 114; X is 86 and Y is 115; X is 86 and Y is 116; X is 86 and Y is 117; X is 86 and Y is 118; X is 86 and Y is 119; X is 86 and Y is 120; X is 86 and Y is 121; X is 86 and Y is 122; X is 86 and Y is 123; X is 86 and Y is 124; X is 86 and Y is 125; X is 86 and Y is 126; X is 86 and Y is 127; X is 86 and Y is 128; X is 86 and Y is 129; X is 86 and Y is 130; X is 86 and Y is 131; X is 86 and Y is 132; X is 86 and Y is 133; X is 86 and Y is 134; X is 86 and Y is 135; X is 86 and Y is 136; X is 86 and Y is 137; X is 86 and Y is 138; X is 86 and Y is 139; X is 86 and Y is 140; X is 86 and Y is 141; X is 86 and Y is 142; X is 86 and Y is 143; X is 86 and Y is 144; X is 86 and Y is 145; X is 86 and Y is 146; X is 86 and Y is 147; X is 86 and Y is 148; X is 86 and Y is 149; X is 86 and Y is 150; X is 86 and Y is 151; X is 86 and Y is 152; X is 86 and Y is 153; X is 86 and Y is 154; X is 86 and Y is 155; X is 86 and Y is 156; X is 86 and Y is 157; X is 86 and Y is 158; X is 86 and Y is 159; X is 86 and Y is 160; X is 86 and Y is 161; X is 86 and Y is 162; X is 86 and Y is 163; X is 86 and Y is 164; X is 86 and Y is 165; X is 86 and Y is 166; X is 86 and Y is 167; X is 86 and Y is 168; X is 86 and Y is 169; X is 86 and Y is 170; X is 86 and Y is 171; X is 86 and Y is 172; X is 86 and Y is 173; X is 86 and Y is 174; X is 86 and Y is 175; X is 86 and Y is 176; X is 86 and Y is 177; X is 86 and Y is 178; X is 86 and Y is 179; X is 86 and Y is 180; X is 86 and Y is 181; X is 86 and Y is 182; X is 86 and Y is 183; X is 86 and Y is 184; X is 86 and Y is 185; X is 86 and Y is 186;

X is 87 and Y is 1; X is 87 and Y is 2; X is 87 and Y is 3; X is 87 and Y is 4; X is 87 and Y is 5; X is 87 and Y is 6; X is 87 and Y is 7; X is 87 and Y is 8; X is 87 and Y is 9; X is 87 and Y is 10; X is 87 and Y is 11; X is 87 and Y is 12; X is 87 and Y is 13; X is 87 and Y is 14; X is 87 and Y is 15; X is 87 and Y is 16; X is 87 and Y is 17; X is 87 and Y is 18; X is 87 and Y is 19; X is 87 and Y is 20; X is 87 and Y is 21; X is 87 and Y is 22; X is 87 and Y is 23; X is 87 and Y is 24; X is 87 and Y is 25; X is 87 and Y is 26; X is 87 and Y is 27; X is 87 and Y is 28; X is 87 and Y is 29; X is 87 and Y is 30; X is 87 and Y is 31; X is 87 and Y is 32; X is 87 and Y is 33; X is 87 and Y is 34; X is 87 and Y is 35; X is 87 and Y is 36; X is 87 and Y is 37; X is 87 and Y is 38; X is 87 and Y is 39; X is 87 and Y is 40; X is 87 and Y is 41; X is 87 and Y is 42; X is 87 and Y is 43; X is 87 and Y is 44; X is 87 and Y is 45; X is 87 and Y is 46; X is 87 and Y is 47; X is 87 and Y is 48; X is 87 and Y is 49; X is 87 and Y is 50; X is 87 and Y is 51; X is 87 and Y is 52; X is 87 and Y is 53; X is 87 and Y is 54; X is 87 and Y is 55; X is 87 and Y is 56; X is 87 and Y is 57; X is 87 and Y is 58; X is 87 and Y is 59; X is 87 and Y is 60; X is 87 and Y is 61; X is 87 and Y is 62; X is 87 and Y is 63; X is 87 and Y is 64; X is 87 and Y is 65; X is 87 and Y is 66; X is 87 and Y is 67; X is 87 and Y is 68; X is 87 and Y is 69; X is 87 and Y is 70; X is 87 and Y is 71; X is 87 and Y is 72; X is 87 and Y is 73; X is 87 and Y is 74; X is 87 and Y is 75; X is 87 and Y is 76; X is 87 and Y is 77; X is 87 and Y is 78; X is 87 and Y is 79; X is 87 and Y is 80; X is 87 and Y is 81; X is 87 and Y is 82; X is 87 and Y is 83; X is 87 and Y is 84; X is 87 and Y is 85; X is 87 and Y is 86; X is 87 and Y is 87; X is 87 and Y is 88; X is 87 and Y is 89; X is 87 and Y is 90; X is 87 and Y is 91; X is 87 and Y is 92; X is 87 and Y is 93; X is 87 and Y is 94; X is 87 and Y is 95; X is 87 and Y is 96; X is 87 and Y is 97; X is 87 and Y is 98; X is 87 and Y is 99; X is 87 and Y is 100; X is 87 and Y is 101; X is 87 and Y is 102; X is 87 and Y is 103; X is 87 and Y is 104; X is 87 and Y is 105; X is 87 and Y is 106; X is 87 and Y is 107; X is 87 and Y is 108; X is 87 and Y is 109; X is 87 and Y is 110; X is 87 and Y is 111; X is 87 and Y is 112; X is 87 and Y is 113; X is 87 and Y is 114; X is 87 and Y is 115; X is 87 and Y is 116; X is 87 and Y is 117; X is 87 and Y is 118; X is 87 and Y is 119; X is 87 and Y is 120; X is 87 and Y is 121; X is 87 and Y is 122; X is 87 and Y is 123; X is 87 and Y is 124; X is 87 and Y is 125; X is 87 and Y is 126; X is 87 and Y is 127; X is 87 and Y is 128; X is 87 and Y is 129; X is 87 and Y is 130; X is 87 and Y is 131; X is 87 and Y is 132; X is 87 and Y is 133; X is 87 and Y is 134; X is 87 and Y is 135; X is 87 and Y is 136; X is 87 and Y is 137; X is 87 and Y is 138; X is 87 and Y is 139; X is 87 and Y is 140; X is 87 and Y is 141; X is 87 and Y is 142; X is 87 and Y is 143; X is 87 and Y is 144; X is 87 and Y is 145; X is 87 and Y is 146; X is 87 and Y is 147; X is 87 and Y is 148; X is 87 and Y is 149; X is 87 and Y is 150; X is 87 and Y is 151; X is 87 and Y is 152; X is 87 and Y is 153; X is 87 and Y is 154; X is 87 and Y is 155; X is 87 and Y is 156; X is 87 and Y is 157; X is 87 and Y is 158; X is 87 and Y is 159; X is 87 and Y is 160; X is 87 and Y is 161; X is 87 and Y is 162; X is 87 and Y is 163; X is 87 and Y is 164; X is 87 and Y is 165; X is 87 and Y is 166; X is 87 and Y is 167; X is 87 and Y is 168; X is 87 and Y is 169; X is 87 and Y is 170; X is 87 and Y is 171; X is 87 and Y is 172; X is 87 and Y is 173; X is 87 and Y is 174; X is 87 and Y is 175; X is 87 and Y is 176; X is 87 and Y is 177; X is 87 and Y is 178; X is 87 and Y is 179; X is 87 and Y is 180; X is 87 and Y is 181; X is 87 and Y is 182; X is 87 and Y is 183; X is 87 and Y is 184; X is 87 and Y is 185; X is 87 and Y is 186; X is 88 and Y is 1; X is 88 and Y is 2; X is 88 and Y is 3; X is 88 and Y is 4; X is 88 and Y is 5; X is 88 and Y is 6; X is 88 and Y is 7; X is 88 and Y is 8; X is 88 and Y is 9; X is 88 and Y is 10; X is 88 and Y is 11; X is 88 and Y is 12; X is 88 and Y is 13; X is 88 and Y is 14; X is 88 and Y is 15; X is 88 and Y is 16; X is 88 and Y is 17; X is 88 and Y is 18; X is 88 and Y is 19; X is 88 and Y is 20; X is 88 and Y is 21; X is 88 and Y is 22; X is 88 and Y is 23; X is 88 and Y is 24; X is 88 and Y is 25; X is 88 and Y is 26; X is 88 and Y is 27; X is 88 and Y is 28; X is 88 and Y is 29; X is 88 and Y is 30; X is 88 and Y is 31; X is 88 and Y is 32; X is 88 and Y is 33; X is 88 and Y is 34; X is 88 and Y is 35; X is 88 and Y is 36; X is 88 and Y is 37; X is 88 and Y is 38; X is 88 and Y is 39; X is 88 and Y is 40; X is 88 and Y is 41; X is 88 and Y is 42; X is 88 and Y is 43; X is 88 and Y is 44; X is 88 and Y is 45; X is 88 and Y is 46; X is 88 and Y is 47; X is 88 and Y is 48; X is 88 and Y is 49; X is 88 and Y is 50; X is 88 and Y is 51; X is 88 and Y is 52; X is 88 and Y is 53; X is 88 and Y is 54; X is 88 and Y is 55; X is 88 and Y is 56; X is 88 and Y is 57; X is 88 and Y is 58; X is 88 and Y is 59; X is 88 and Y is 60; X is 88 and Y is 61; X is 88 and Y is 62; X is 88 and Y is 63; X is 88 and Y is 64; X is 88 and Y is 65; X is 88 and Y is 66; X is 88 and Y is 67; X is 88 and Y is 68; X is 88 and Y is 69; X is 88 and Y is 70; X is 88 and Y is 71; X is 88 and Y is 72; X is 88 and Y is 73; X is 88 and Y is 74; X is 88 and Y is 75; X is 88 and Y is 76; X is 88 and Y is 77; X is 88 and Y is 78; X is 88 and Y is 79; X is 88 and Y is 80; X is 88 and Y is 81; X is 88 and Y is 82; X is 88 and Y is 83; X is 88 and Y is 84; X is 88 and Y is 85; X is 88 and Y is 86; X is 88 and Y is 87; X is 88 and Y is 88; X is 88 and Y is 89; X is 88 and Y is 90; X is 88 and Y is 91; X is 88 and Y is 92; X is 88 and Y is 93; X is 88 and Y is 94; X is 88 and Y is 95; X is 88 and Y is 96; X is 88 and Y is 97; X is 88 and Y is 98; X is 88 and Y is 99; X is 88 and Y is 100; X is 88 and Y is 101; X is 88 and Y is 102; X is 88 and Y is 103; X is 88 and Y is 104; X is 88 and Y is 105; X is 88 and Y is 106; X is 88 and Y is 107; X is 88 and Y is 108; X is 88 and Y is 109; X is 88 and Y is 110; X is 88 and Y is 111; X is 88 and Y is 112; X is 88 and Y is 113; X is 88 and Y is 114; X is 88 and Y is 115; X is 88 and Y is 116; X is 88 and Y is 117; X is 88 and Y is 118; X is 88 and Y is 119; X is 88 and Y is 120; X is 88 and Y is 121; X is 88 and Y is 122; X is 88 and Y is 123; X is 88 and Y is 124; X is 88 and Y is 125; X is 88 and Y is 126; X is 88 and Y is 127; X is 88 and Y is 128; X is 88 and Y is 129; X is 88 and Y is 130; X is 88 and Y is 131; X is 88 and Y is 132; X is 88 and Y is 133; X is 88 and Y is 134; X is 88 and Y is 135; X is 88 and Y is 136; X is 88 and Y is 137; X is 88 and Y is 138; X is 88 and Y is 139; X is 88 and Y is 140; X is 88 and Y is 141; X is 88 and Y is 142; X is 88 and Y is 143; X is 88 and Y is 144; X is 88 and Y is 145; X is 88 and Y is 146; X is 88 and Y is 147; X is 88 and Y is 148; X is 88 and Y is 149; X is 88 and Y is 150; X is 88 and Y is 151; X is 88 and Y is 152; X is 88 and Y is 153; X is 88 and Y is 154; X is 88 and Y is 155; X is 88 and Y is 156; X is 88 and Y is 157; X is 88 and Y is 158; X is 88 and Y is 159; X is 88 and Y is 160; X is 88 and Y is 161; X is 88 and Y is 162; X is 88 and Y is 163; X is 88 and Y is 164; X is 88 and Y is 165; X is 88 and Y is 166; X is 88 and Y is 167; X is 88 and Y is 168; X is 88 and Y is 169; X is 88 and Y is 170; X is 88 and Y is 171; X is 88 and Y is 172; X is 88 and Y is 173; X is 88 and Y is 174; X is 88 and Y is 175; X is 88 and Y is 176; X is 88 and Y is 177; X is 88 and Y is 178; X is 88 and Y is 179; X is 88 and Y is 180; X is 88 and Y is 181; X is 88 and Y is 182; X is 88 and Y is 183; X is 88 and Y is 184; X is 88 and Y is 185; X is 88 and Y is 186; X is 89 and Y is 1; X is 89 and Y is 2; X is 89 and Y is 3; X is 89 and Y is 4; X is 89 and Y is 5; X is 89 and Y is 6; X is 89 and Y is 7; X is 89 and Y is 8; X is 89 and Y is 9; X is 89 and Y is 10; X is 89 and Y is 11; X is 89 and Y is 12; X is 89 and Y is 13; X is 89 and Y is 14; X is 89 and Y is 15; X is 89 gild Y is 16; X is 89 and Y is 17; X is 89 and Y is 18; X is 89 and Y is 19; X is 89 and Y is 20; X is 89 and Y is 21; X is 89 and Y is 22; X is 89 and Y is 23; X is 89 and Y is 24; X is 89 and Y is 25; X is 89 and Y is 26; X is 89 and Y is 27; X is 89 and Y is 28; X is 89 and Y is 29; X is 89 and Y is 30; X is 89 and Y is 31; X is 89 and Y is 32; X is 89 and Y is 33; X is 89 and Y is 34; X is 89 and Y is 35; X is 89 and Y is 36; X is 89 and Y is 37; X is 89 and Y is 38; X is 89 and Y is 39; X is 89 and Y is 40; X is 89 and Y is 41; X is 89 and Y is 42; X is 89 and Y is 43; X is 89 and Y is 44; X is 89 and Y is 45; X is 89 and Y is 46; X is 89 and Y is 47; X is 89 and Y is 48; X is 89 and Y is 49; X is 89 and Y is 50; X is 89 and Y is 51; X is 89 and Y is 52; X is 89 and Y is 53; X is 89 and Y is 54; X is 89 and Y is 55; X is 89 and Y is 56; X is 89 and Y is 57; X is 89 and Y is 58; X is 89 and Y is 59; X is 89 and Y is 60; X is 89 and Y is 61; X is 89 and Y is 62; X is 89 and Y is 63; X is 89 and Y is 64; X is 89 and Y is 65; X is 89 and Y is 66; X is 89 and Y is 67; X is 89 and Y is 68; X is 89 and Y is 69; X is 89 and Y is 70; X is 89 and Y is 71; X is 89 and Y is 72; X is 89 and Y is 73; X is 89 and Y is 74; X is 89 and Y is 75; X is 89 and Y is 76; X is 89 and Y is 77; X is 89 and Y is 78; X is 89 and Y is 79; X is 89 and Y is 80; X is 89 and Y is 81; X is 89 and Y is 82; X is 89 and Y is 83; X is 89 and Y is 84; X is 89 and Y is 85; X is 89 and Y is 86; X is 89 and Y is 87; X is 89 and Y is 88; X is 89 and Y is 89; X is 89 and Y is 90; X is 89 and Y is 91; X is 89 and Y is 92; X is 89 and Y is 93; X is 89 and Y is 94; X is 89 and Y is 95; X is 89 and Y is 96; X is 89 and Y is 97; X is 89 and Y is 98; X is 89 and Y is 99; X is 89 and Y is 100; X is 89 and Y is 101; X is 89 and Y is 102; X is 89 and Y is 103; X is 89 and Y is 104; X is 89 and Y is 105; X is 89 and Y is 106; X is 89 and Y is 107; X is 89 and Y is 108; X is 89 and Y is 109; X is 89 and Y is 110; X is 89 and Y is 111; X is 89 and Y is 112; X is 89 and Y is 113; X is 89 and Y is 114; X is 89 and Y is 115; X is 89 and Y is 116; X is 89 and Y is 117; X is 89 and Y is 118; X is 89 and Y is 119; X is 89 and Y is 120; X is 89 and Y is 121; X is 89 and Y is 122; X is 89 and Y is 123; X is 89 and Y is 124; X is 89 and Y is 125; X is 89 and Y is 126; X is 89 and Y is 127; X is 89 and Y is 128; X is 89 and Y is 129; X is 89 and Y is 130; X is 89 and Y is 131; X is 89 and Y is 132; X is 89 and Y is 133; X is 89 and Y is 134; X is 89 and Y is 135; X is 89 and Y is 136; X is 89 and Y is 137; X is 89 and Y is 138; X is 89 and Y is 139; X is 89 and Y is 140; X is 89 and Y is 141; X is 89 and Y is 142; X is 89 and Y is 143; X is 89 and Y is 144; X is 89 and Y is 145; X is 89 and Y is 146; X is 89 and Y is 147; X is 89 and Y is 148; X is 89 and Y is 149; X is 89 and Y is 150; X is 89 and Y is 151; X is 89 and Y is 152; X is 89 and Y is 153; X is 89 and Y is 154; X is 89 and Y is 155; X is 89 and Y is 156; X is 89 and Y is 157; X is 89 and Y is 158; X is 89 and Y is 159; X is 89 and Y is 160; X is 89 and Y is 161; X is 89 and Y is 162; X is 89 and Y is 163; X is 89 and Y is 164; X is 89 and Y is 165; X is 89 and Y is 166; X is 89 and Y is 167; X is 89 and Y is 168; X is 89 and Y is 169; X is 89 and Y is 170; X is 89 and Y is 171; X is 89 and Y is 172; X is 89 and Y is 173; X is 89 and Y is 174; X is 89 and Y is 175; X is 89 and Y is 176; X is 89 and Y is 177; X is 89 and Y is 178; X is 89 and Y is 179; X is 89 and Y is 180; X is 89 and Y is 181; X is 89 and Y is 182; X is 89 and Y is 183; X is 89 and Y is 184; X is 89 and Y is 185; X is 89 and Y is 186; X is 90 and Y is 1; X is 90 and Y is 2; X is 90 and Y is 3; X is 90 and Y is 4; X is 90 and Y is 5; X is 90 and Y is 6; X is 90 and Y is 7; X is 90 and Y is 8; X is 90 and Y is 9; X is 90 and Y is 10; X is 90 and Y is 11; X is 90 and Y is 12; X is 90 and Y is 13; X is 90 and Y is 14; X is 90 and Y is 15; X is 90 and Y is 16; X is 90 and Y is 17; X is 90 and Y is 18; X is 90 and Y is 19; X is 90 and Y is 20; X is 90 and Y is 21; X is 90 and Y is 22; X is 90 and Y is 23; X is 90 and Y is 24; X is 90 and Y is 25; X is 90 and Y is 26; X is 90 and Y is 27; X is 90 and Y is 28; X is 90 and Y is 29; X is 90 and Y is 30; X is 90 and Y is 31; X is 90 and Y is 32; X is 90 and Y is 33; X is 90 and Y is 34; X is 90 and Y is 35; X is 90 and Y is 36; X is 90 and Y is 37; X is 90 and Y is 38; X is 90 and Y is 39; X is 90 and Y is 40; X is 90 and Y is 41; X is 90 and Y is 42; X is 90 and Y is 43; X is 90 and Y is 44; X is 90 and Y is 45; X is 90 and Y is 46; X is 90 and Y is 47; X is 90 and Y is 48; X is 90 and Y is 49; X is 90 and Y is 50; X is 90 and Y is 51; X is 90 and Y is 52; X is 90 and Y is 53; X is 90 and Y is 54; X is 90 and Y is 55; X is 90 and Y is 56; X is 90 and Y is 57; X is 90 and Y is 58; X is 90 and Y is 59; X is 90 and Y is 60; X is 90 and Y is 61; X is 90 and Y is 62; X is 90 and Y is 63; X is 90 and Y is 64; X is 90 and Y is 65; X is 90 and Y is 66; X is 90 and Y is 67; X is 90 and Y is 68; X is 90 and Y is 69; X is 90 and Y is 70; X is 90 and Y is 71; X is 90 and Y is 72; X is 90 and Y is 73; X is 90 and Y is 74; X is 90 and Y is 75; X is 90 and Y is 76; X is 90 and Y is 77; X is 90 and Y is 78; X is 90 and Y is 79; X is 90 and Y is 80; X is 90 and Y is 81; X is 90 and Y is 82; X is 90 and Y is 83; X is 90 and Y is 84; X is 90 and Y is 85; X is 90 and Y is 86; X is 90 and Y is 87; X is 90 and Y is 88; X is 90 and Y is 89; X is 90 and Y is 90; X is 90 and Y is 91; X is 90 and Y is 92; X is 90 and Y is 93; X is 90 and Y is 94; X is 90 and Y is 95; X is 90 and Y is 96; X is 90 and Y is 97; X is 90 and Y is 98; X is 90 and Y is 99; X is 90 and Y is 100; X is 90 and Y is 101; X is 90 and Y is 102; X is 90 and Y is 103; X is 90 and Y is 104; X is 90 and Y is 105; X is 90 and Y is 106; X is 90 and Y is 107; X is 90 and Y is 108; X is 90 and Y is 109; X is 90 and Y is 110; X is 90 and Y is 111; X is 90 and Y is 112; X is 90 and Y is 113; X is 90 and Y is 114; X is 90 and Y is 115; X is 90 and Y is 116; X is 90 and Y is 117; X is 90 and Y is 118; X is 90 and Y is 119; X is 90 and Y is 120; X is 90 and Y is 121; X is 90 and Y is 122; X is 90 and Y is 123; X is 90 and Y is 124; X is 90 and Y is 125; X is 90 and Y is 126; X is 90 and Y is 127; X is 90 and Y is 128; X is 90 and Y is 129; X is 90 and Y is 130; X is 90 and Y is 131; X is 90 and Y is 132; X is 90 and Y is 133; X is 90 and Y is 134; X is 90 and Y is 135; X is 90 and Y is 136; X is 90 and Y is 137; X is 90 and Y is 138; X is 90 and Y is 139; X is 90 and Y is 140; X is 90 and Y is 141; X is 90 and Y is 142; X is 90 and Y is 143; X is 90 and Y is 144; X is 90 and Y is 145; X is 90 and Y is 146; X is 90 and Y is 147; X is 90 and Y is 148; X is 90 and Y is 149; X is 90 and Y is 150; X is 90 and Y is 151; X is 90 and Y is 152; X is 90 and Y is 153; X is 90 and Y is 154; X is 90 and Y is 155; X is 90 and Y is 156; X is 90 and Y is 157; X is 90 and Y is 158; X is 90 and Y is 159; X is 90 and Y is 160; X is 90 and Y is 161; X is 90 and Y is 162; X is 90 and Y is 163; X is 90 and Y is 164; X is 90 and Y is 165; X is 90 and Y is 166; X is 90 and Y is 167; X is 90 and Y is 168; X is 90 and Y is 169; X is 90 and Y is 170; X is 90 and Y is 171; X is 90 and Y is 172; X is 90 and Y is 173; X is 90 and Y is 174; X is 90 and Y is 175; X is 90 and Y is 176; X is 90 and Y is 177; X is 90 and Y is 178; X is 90 and Y is 179; X is 90 and Y is 180; X is 90 and Y is 181; X is 90 and is 182; X is 90 and Y is 183; X is 90 and Y is 184; X is 90 and Y is 185; X is 90 and Y is 186; X is 91 and Y is 1; X is 91 and Y is 2; X is 91 and Y is 3; X is 91 and Y is 4; X is 91 and Y is 5; X is 91 and Y is 6; X is 91 and Y is 7; X is 91 and Y is 8; X is 91 and Y is 9; X is 91 and Y is 10; X is 91 and Y is 11; X is 91 and Y is 12; X is 91 and Y is 13; X is 91 and Y is 14; X is 91 and Y is 15; X is 91 and Y is 16; X is 91 and Y is 17; X is 91 and Y is 18; X is 91 and Y is 19; X is 91 and Y is 20; X is 91 and Y is 21; X is 91 and Y is 22; X is 91 and Y is 23; X is 91 and Y is 24; X is 91 and Y is 25; X is 91 and Y is 26; X is 91 and Y is 27; X is 91 and Y is 28; X is 91 and Y is 29; X is 91 and Y is 30; X is 91 and Y is 31; X is 91 and Y is 32; X is 91 and Y is 33; X is 91 and Y is 34; X is 91 and Y is 35; X is 91 and Y is 36; X is 91 and Y is 37; X is 91 and Y is 38; X is 91 and Y is 39; X is 91 and Y is 40; X is 91 and Y is 41; X is 91 and Y is 42; X is 91 and Y is 43; X is 91 and Y is 44; X is 91 and Y is 45; X is 91 and Y is 46; X is 91 and Y is 47; X is 91 and Y is 48; X is 91 and Y is 49; X is 91 and Y is 50; X is 91 and Y is 51; X is 91 and Y is 52; X is 91 and Y is 53; X is 91 and Y is 54; X is 91 and Y is 55; X is 91 and Y is 56; X is 91 and Y is 57; X is 91 and Y is 58; X is 91 and Y is 59; X is 91 and Y is 60; X is 91 and Y is 61; X is 91 and Y is 62; X is 91 and Y is 63; X is 91 and Y is 64; X is 91 and Y is 65; X is 91 and Y is 66; X is 91 and Y is 67; X is 91 and Y is 68; X is 91 and Y is 69; X is 91 and Y is 70; X is 91 and Y is 71; X is 91 and Y is 72; X is 91 and Y is 73; X is 91 and Y is 74; X is 91 and Y is 75; X is 91 and Y is 76; X is 91 and Y is 77; X is 91 and Y is 78; X is 91 and Y is 79; X is 91 and Y is 80; X is 91 and Y is 81; X is 91 and Y is 82; X is 91 and Y is 83; X is 91 and Y is 84; X is 91 and Y is 85; X is 91 and Y is 86; X is 91 and Y is 87; X is 91 and Y is 88; X is 91 and Y is 89; X is 91 and Y is 90; X is 91 and Y is 91; X is 91 and Y is 92; X is 91 and Y is 93; X is 91 and Y is 94; X is 91 and Y is 95; X is 91 and Y is 96; X is 91 and Y is 97; X is 91 and Y is 98; X is 91 and Y is 99; X is 91 and Y is 100; X is 91 and Y is 101; X is 91 and Y is 102; X is 91 and Y is 103; X is 91 and Y is 104; X is 91 and Y is 105; X is 91 and Y is 106; X is 91 and Y is 107; X is 91 and Y is 108; X is 91 and Y is 109; X is 91 and Y is 110; X is 91 and Y is 111; X is 91 and Y is 112; X is 91 and Y is 113; X is 91 and Y is 114; X is 91 and Y is 115; X is 91 and Y is 116; X is 91 and Y is 117; X is 91 and Y is 118; X is 91 and Y is 119; X is 91 and Y is 120; X is 91 and Y is 121; X is 91 and Y is 122; X is 91 and Y is 123; X is 91 and Y is 124; X is 91 and Y is 125; X is 91 and Y is 126; X is 91 and Y is 127; X is 91 and Y is 128; X is 91 and Y is 129; X is 91 and Y is 130; X is 91 and Y is 131; X is 91 and Y is 132; X is 91 and Y is 133; X is 91 and Y is 134; X is 91 and Y is 135; X is 91 and Y is 136; X is 91 and Y is 137; X is 91 and Y is 138; X is 91 and Y is 139; X is 91 and Y is 140; X is 91 and Y is 141; X is 91 and Y is 142; X is 91 and Y is 143; X is 91 and Y is 144; X is 91 and Y is 145; X is 91 and Y is 146; X is 91 and Y is 147; X is 91 and Y is 148; X is 91 and Y is 149; X is 91 and Y is 150; X is 91 and Y is 151; X is 91 and Y is 152; X is 91 and Y is 153; X is 91 and Y is 154; X is 91 and Y is 155; X is 91 and Y is 156; X is 91 and Y is 157; X is 91 and Y is 158; X is 91 and Y is 159; X is 91 and Y is 160; X is 91 and Y is 161; X is 91 and Y is 162; X is 91 and Y is 163; X is 91 and Y is 164; X is 91 and Y is 165; X is 91 and Y is 166; X is 91 and Y is 167; X is 91 and Y is 168; X is 91 and Y is 169; X is 91 and Y is 170; X is 91 and Y is 171; X is 91 and Y is 172; X is 91 and Y is 173; X is 91 and Y is 174; X is 91 and Y is 175; X is 91 and Y is 176; X is 91 and Y is 177; X is 91 and Y is 178; X is 91 and Y is 179; X is 91 and Y is 180; X is 91 and Y is 181; X is 91 and Y is 182; X is 91 and Y is 183; X is 91 and Y is 184; X is 91 and Y is 185; X is 91 and Y is 186; X is 92 and Y is 1; X is 92 and Y is 2; X is 92 and Y is 3; X is 92 and Y is 4; X is 92 and Y is 5; X is 92 and Y is 6; X is 92 and Y is 7; X is 92 and Y is 8; X is 92 and Y is 9; X is 92 and Y is 10; X is 92 and Y is 11; X is 92 and Y is 12; X is 92 and Y is 13; X is 92 and Y is 14; X is 92 and Y is 15; X is 92 and Y is 16; X is 92 and Y is 17; X is 92 and Y is 18; X is 92 and Y is 19; X is 92 and Y is 20; X is 92 and Y is 21; X is 92 and Y is 22; X is 92 and Y is 23; X is 92 and Y is 24; X is 92 and Y is 25; X is 92 and Y is 26; X is 92 and Y is 27; X is 92 and Y is 28; X is 92 and Y is 29; X is 92 and Y is 30; X is 92 and Y is 31; X is 92 and Y is 32; X is 92 and Y is 33; X is 92 and Y is 34; X is 92 and Y is 35; X is 92 and Y is 36; X is 92 and Y is 37; X is 92 and Y is 38; X is 92 and Y is 39; X is 92 and Y is 40; X is 92 and Y is 41; X is 92 and Y is 42; X is 92 and Y is 43; X is 92 and Y is 44; X is 92 and Y is 45; X is 92 and Y is 46; X is 92 and Y is 47; X is 92 and Y is 48; X is 92 and Y is 49; X is 92 and Y is 50; X is 92 and Y is 51; X is 92 and Y is 52; X is 92 and Y is 53; X is 92 and Y is 54; X is 92 and Y is 55; X is 92 and Y is 56; X is 92 and Y is 57; X is 92 and Y is 58; X is 92 and Y is 59; X is 92 and Y is 60; X is 92 and Y is 61; X is 92 and Y is 62; X is 92 and Y is 63; X is 92 and Y is 64; X is 92 and Y is 65; X is 92 and Y is 66; X is 92 and Y is 67; X is 92 and Y is 68; X is 92 and Y is 69; X is 92 and Y is 70; X is 92 and Y is 71; X is 92 and Y is 72; X is 92 and Y is 73; X is 92 and Y is 74; X is 92 and Y is 75; X is 92 and Y is 76; X is 92 and Y is 77; X is 92 and Y is 78; X is 92 and Y is 79; X is 92 and Y is 80; X is 92 and Y is 81; X is 92 and Y is 82; X is 92 and Y is 83; X is 92 and Y is 84; X is 92 and Y is 85; X is 92 and Y is 86; X is 92 and Y is 87; X is 92 and Y is 88; X is 92 and Y is 89; X is 92 and Y is 90; X is 92 and Y is 91; X is 92 and Y is 92; X is 92 and Y is 93; X is 92 and Y is 94; X is 92 and Y is 95; X is 92 and Y is 96; X is 92 and Y is 97; X is 92 and Y is 98; X is 92 and Y is 99; X is 92 and Y is 100; X is 92 and Y is 101; X is 92 and Y is 102; X is 92 and Y is 103; X is 92 and Y is 104; X is 92 and Y is 105; X is 92 and Y is 106; X is 92 and Y is 107; X is 92 and Y is 108; X is 92 and Y is 109; X is 92 and Y is 110; X is 92 and Y is 111; X is 92 and Y is 112; X is 92 and Y is 113; X is 92 and Y is 114; X is 92 and Y is 115; X is 92 and Y is 116; X is 92 and Y is 117; X is 92 and Y is 118; X is 92 and Y is 119; X is 92 and Y is 120; X is 92 and Y is 121; X is 92 and Y is 122; X is 92 and Y is 123; X is 92 and Y is 124; X is 92 and Y is 125; X is 92 and Y is 126; X is 92 and Y is 127; X is 92 and Y is 128; X is 92 and Y is 129; X is 92 and Y is 130; X is 92 and Y is 131; X is 92 and Y is 132; X is 92 and Y is 133; X is 92 and Y is 134; X is 92 and Y is 135; X is 92 and Y is 136; X is 92 and Y is 137; X is 92 and Y is 138; X is 92 and Y is 139; X is 92 and Y is 140; X is 92 and Y is 141; X is 92 and Y is 142; X is 92 and Y is 143; X is 92 and Y is 144; X is 92 and Y is 145; X is 92 and Y is 146; X is 92 and Y is 147; X is 92 and Y is 148; X is 92 and Y is 149; X is 92 and Y is 150; X is 92 and Y is 151; X is 92 and Y is 152; X is 92 and Y is 153; X is 92 and Y is 154; X is 92 and Y is 155; X is 92 and Y is 156; X is 92 and Y is 157; X is 92 and Y is 158; X is 92 and Y is 159; X is 92 and Y is 160; X is 92 and Y is 161; X is 92 and Y is 162; X is 92 and Y is 163; X is 92 and Y is 164; X is 92 and Y is 165; X is 92 and Y is 166; X is 92 and Y is 167; X is 92 and Y is 168; X is 92 and Y is 169; X is 92 and Y is 170; X is 92 and Y is 171; X is 92 and Y is 172; X is 92 and Y is 173; X is 92 and Y is 174; X is 92 and Y is 175; X is 92 and Y is 176; is 92 and Y is 177; X is 92 and Y is 178; X is 92 and Y is 179; X is 92 and Y is 180; X is 92 and Y is 181; X is 92 and Y is 182; X is 92 and Y is 183; X is 92 and Y is 184; X is 92 and Y is 185; or X is 92 and Y is 186.

In one embodiment, X is 3 and Y is 5.

The term "one or more CDRs", as used in connection with the above embodiments, refers to one of the CDRs HCDR1, HCDR2, HCDR3, LCDR1, LCDR2 and LCDR3 (e.g., HCDR3), or several (i.e., 2, 3, 4, 5 or 6) of the CDRs, such as a set of HCDR1, HCDR2 and HCDR3 or a set of LCDR1, LCDR2 and LCDR3. In a preferred embodiment, the term "one or more CDRs" refers to all six CDRs, i.e., HCDR1, HCDR2, HCDR3, LCDR1, LCDR2 and LCDR3.

The term "one or more variable domains", as used in connection with the above embodiments, preferably refers to one of the VH domain and the VL domain or, more preferably, to both the VH domain and the VL domain.

The term "nucleic acid molecule", as used herein, is intended to include DNA and RNA, such as genomic DNA, cDNA, mRNA, recombinantly produced and chemically synthesized molecules. A nucleic acid molecule may be single-stranded or double-stranded. RNA includes in vitro transcribed RNA (IVT RNA) or synthetic RNA.

In the context of the present invention, the term "DNA" relates to a molecule which comprises deoxyribonucleotide residues and preferably is entirely or substantially composed of deoxyribonucleotide residues. "Deoxyribonucleotide" relates to a nucleotide which lacks a hydroxyl group at the 2'-position of a β-D-ribofuranosyl group. The term "DNA" comprises isolated DNA such as partially or completely purified DNA, essentially pure DNA, synthetic DNA, and recombinantly generated DNA and includes modified DNA which differs from naturally occurring DNA by addition, deletion, substitution and/or alteration of one or more nucleotides. Such alterations can include addition of non-nucleotide material, such as to the end(s) of a DNA or internally, for example at one or more nucleotides of the DNA. Nucleotides in DNA molecules can also comprise non-standard nucleotides, such as non-naturally occurring nucleotides or chemically synthesized nucleotides. These altered DNAs can be referred to as analogs or analogs of naturally-occurring DNA.

In the context of the present invention, the term "RNA" relates to a molecule which comprises ribonucleotide residues and preferably being entirely or substantially composed of ribonucleotide residues. "Ribonucleotide" relates to a nucleotide with a hydroxyl group at the 2'-position of a β-D-ribofuranosyl group. The term includes double stranded RNA, single stranded RNA, isolated RNA such as partially purified RNA, essentially pure RNA, synthetic RNA, recombinantly produced RNA, as well as modified RNA that differs from naturally occurring RNA by the addition, deletion, substitution and/or alteration of one or more nucleotides. Such alterations can include addition of non-nucleotide material, such as to the end(s) of a RNA or internally, for example at one or more nucleotides of the RNA. Nucleotides in RNA molecules can also comprise non-standard nucleotides, such as non-naturally occurring nucleotides or chemically synthesized nucleotides or deoxynucleotides. These altered RNAs can be referred to as analogs or analogs of naturally-occurring RNA. According to the present invention, the term "RNA" includes and preferably relates to "mRNA" which means "messenger RNA" and relates to a transcript which may be produced using DNA as template and encodes a peptide or protein. mRNA typically comprises a 5' non translated region (5'-UTR), a protein or peptide coding region and a 3' non translated region (3'-UTR). mRNA has a limited halftime in cells and in vitro. Preferably, mRNA is produced by in vitro transcription using a DNA template. In one embodiment of the invention, the RNA is obtained by in vitro transcription or chemical synthesis. The in vitro transcription methodology is known to the skilled person. For example, there is a variety of in vitro transcription kits commercially available.

The nucleic acid molecule according to the present invention may be contained/comprised in a vector. The term "vector", as used herein, includes any vectors known to the skilled person, including plasmid vectors, cosmid vectors, phage vectors, such as lambda phage, viral vectors, such as adenoviral or baculoviral vectors, or artificial chromosome vectors such as bacterial artificial chromosomes (BAC), yeast artificial chromosomes (YAC), or P1 artificial chromosomes (PAC). Said vectors include expression as well as cloning vectors. Expression vectors comprise plasmids as well as viral vectors and generally contain a desired coding sequence and appropriate DNA sequences necessary for the expression of the operably linked coding sequence in a particular host organism (e.g., bacteria, yeast, plant, insect, or mammal) or in in vitro expression systems. Cloning vectors are generally used to engineer and amplify a certain desired DNA fragment and may lack functional sequences needed for expression of the desired DNA fragments.

The term "cell" or "host cell" preferably relates to an intact cell, i.e. a cell with an intact membrane that has not released its normal intracellular components such as enzymes, organelles, or genetic material. An intact cell preferably is a viable cell, i.e. a living cell capable of carrying out its normal metabolic functions. Preferably said term relates according to the invention to any cell which can be transfected with an exogenous nucleic acid. Preferably, the cell when transfected with an exogenous nucleic acid and transferred to a recipient can express the nucleic acid in the recipient. The term "cell" includes bacterial cells; other useful cells are yeast cells, fungal cells or mammalian cells. Suitable bacterial cells include cells from gram-negative bacterial strains such as strains of *Escherichia coli, Proteus*, and *Pseudomonas*, and gram-positive bacterial strains such as strains of *Bacillus, Streptomyces, Staphylococcus*, and *Lactococcus*. Suitable fungal cell include cells from species of *Trichoderma, Neurospora*, and *Aspergillus*. Suitable yeast cells include cells from species of *Saccharomyces* (For example *Saccharomyces cerevisiae*), *Schizosaccharomyces* (for example *Schizosaccharomyces pombe*), *Pichia* (for example *Pichia pastoris* and *Pichia methanolica*), and *Hansenula*. Suitable mammalian cells include for example CHO cells, BHK cells, HeLa cells, COS cells, 293 HEK and the like. However, amphibian cells, insect cells, plant cells, and any other cells used in the art for the expression of heterologous proteins can be used as well. Mammalian cells are particularly preferred for adoptive transfer, such as cells from humans, mice, hamsters, pigs, goats, and primates. The cells may be derived from a large number of tissue types and include primary cells and cell lines such as cells of the immune system, in particular antigen-presenting cells (APCs), such as dendritic cells, and T cells, stem cells, such as hematopoietic stem cells and mesenchymal stem cells, and other cell types. An antigen-presenting cell is a cell that displays antigen in the context of major histocompatibility complex on its surface. T cells may recognize this complex using their T cell receptor (TCR).

The binding agents of the invention can be produced either intracellularly (e.g. in the cytosol, in the periplasma or in inclusion bodies) and then isolated from the host cells and optionally further purified; or they can be produced extracellularly (e.g. in the medium in which the host cells are cultured) and then isolated from the culture medium and optionally further purified. Methods and reagents used for the recombinant production of polypeptides, such as specific suitable expression vectors, transformation or transfection methods, selection markers, methods of induction of protein expression, culture conditions, and the like, are known in the art. Similarly, protein isolation and purification techniques are well known to the skilled person.

The binding agents, nucleic acid molecules or cells described herein may be administered in the form of any suitable pharmaceutical composition.

The pharmaceutical compositions of the invention are preferably sterile and contain an effective amount of the binding agents, nucleic acid molecules or cells described herein to generate the desired reaction or the desired effect.

Pharmaceutical compositions are usually provided in a uniform dosage form and may be prepared in a manner known per se. A pharmaceutical composition may, e.g., be in the form of a solution or suspension.

A pharmaceutical composition may further comprise one or more carriers and/or excipients, all of which are preferably pharmaceutically acceptable. The term "pharmaceutically acceptable", as used herein, refers to the non-toxicity of a material which, preferably, does not interact with the action of the active agent of the pharmaceutical composition.

The term "carrier" refers to an organic or inorganic component, of a natural or synthetic nature, in which the active component is combined in order to facilitate, enhance or enable application. According to the invention, the term "carrier" also includes one or more compatible solid or liquid fillers, diluents or encapsulating substances, which are suitable for administration to a subject.

Possible carrier substances for parenteral administration are, e.g., sterile water, Ringer, Ringer lactate, sterile sodium chloride solution, polyalkylene glycols, hydrogenated naphthalenes and, in particular, biocompatible lactide polymers, lactide/glycolide copolymers or polyoxyethylene/polyoxypropylene copolymers.

The term "excipient", as used herein, is intended to include all substances which may be present in a pharmaceutical composition and which are not active ingredients, such as salts, binders, lubricants, thickeners, surface active agents, preservatives, emulsifiers, buffer substances, flavouring agents, or colorants.

Salts, which are not pharmaceutically acceptable, may be used for preparing pharmaceutically acceptable salts and are included in the invention. Pharmaceutically acceptable salts of this kind comprise in a non limiting way those prepared from the following acids: hydrochloric, hydrobromic, sulfuric, nitric, phosphoric, maleic, acetic, salicylic, citric, formic, malonic, succinic acids, and the like. Pharmaceutically acceptable salts may also be prepared as alkali metal salts or alkaline earth metal salts, such as sodium salts, potassium salts or calcium salts.

Suitable preservatives for use in a pharmaceutical composition include benzalkonium chloride, chlorobutanol, paraben and thimerosal.

Suitable buffer substances for use in a pharmaceutical composition include acetic acid in a salt, citric acid in a salt, boric acid in a salt and phosphoric acid in a salt.

The agents and compositions described herein may be administered via any conventional route, such as by parenteral administration including by injection or infusion. Administration is preferably parenterally, e.g. intravenously, intraarterially, subcutaneously, intradermally or intramuscularly.

Pharmaceutical compositions suitable for parenteral administration usually comprise a sterile aqueous or non-aqueous preparation of the active compound, which is preferably isotonic to the blood of the recipient. Examples of compatible carriers/solvents/diluents are Ringer solution and isotonic sodium chloride solution. In addition, usually sterile, fixed oils are used as solution or suspension medium.

The agents and compositions described herein are administered in effective amounts. An "effective amount" refers to the amount, which achieves a desired reaction or a desired effect alone or together with further doses. In the case of treatment of a particular disease or of a particular condition, the desired reaction preferably relates to inhibition of the course of the disease. This comprises slowing down the progress of the disease and, in particular, interrupting or reversing the progress of the disease. The desired reaction in a treatment of a disease or of a condition may also be delay of the onset or a prevention of the onset of said disease or said condition. An effective amount of an agent or composition described herein will depend on the condition to be treated, the severeness of the disease, the individual parameters of the patient, including age, physiological condition, size and weight, the duration of treatment, the type of an accompanying therapy (if present), the specific route of administration and similar factors. Accordingly, the doses administered of the agents described herein may depend on various of such parameters. In the case that a reaction in a patient is insufficient with an initial dose, higher doses (or effectively higher doses achieved by a different, more localized route of administration) may be used.

As used herein, the term "kit of parts (in short: kit)" refers to an article of manufacture comprising one or more containers and, optionally, a data carrier. Said one or more containers may be filled with one or more of the above mentioned means or reagents. Additional containers may be included in the kit that contain, e.g., diluents, buffers and further reagents. Said data carrier may be a non-electronical data carrier, e.g., a graphical data carrier such as an information leaflet, an information sheet, a bar code or an access code, or an electronical data carrier such as a floppy disk, a compact disk (CD), a digital versatile disk (DVD), a microchip or another semiconductor-based electronical data carrier. The access code may allow the access to a database, e.g., an internet database, a centralized, or a decentralized database. Said data carrier may comprise instructions for the use of the binding agent, nucleic acid molecule, cell and/or pharmaceutical composition of the present invention.

The agents and compositions described herein can be administered to patients, e.g., in vivo, to treat or prevent a variety of disorders such as those described herein.

The term "medicament", as used herein, refers to a substance/composition used in therapy, i.e., in the treatment of a disease.

According to the invention, the term "disease" refers to any pathological state, in particular cancer, infectious diseases, inflammatory diseases, metabolic diseases, autoimmune disorders, degenerative diseases, apoptosis-associated diseases and transplant rejections.

As used herein, the term "cancer" includes a disease characterized by aberrantly regulated cellular growth, proliferation, differentiation, adhesion, and/or migration. By "cancer cell" is meant an abnormal cell that grows by a rapid, uncontrolled cellular proliferation and continues to grow after the stimuli that initiated the new growth cease. The term "cancer" according to the invention comprises leukemias, seminomas, melanomas, teratomas, lymphomas, neuroblastomas, gliomas, rectal cancer, endometrial cancer, kidney cancer, adrenal cancer, thyroid cancer, blood cancer, skin cancer, cancer of the brain, cervical cancer, intestinal cancer, liver cancer, colon cancer, stomach cancer, intestine cancer, head and neck cancer, gastrointestinal cancer, lymph node cancer, esophagus cancer, colorectal cancer, pancreas cancer, ear, nose and throat (ENT) cancer, breast cancer, prostate cancer, cancer of the uterus, ovarian cancer and lung cancer and the metastases thereof. Examples thereof are lung carcinomas, mamma carcinomas, prostate carcinomas, colon carcinomas, renal cell carcinomas, cervical carcinomas, or metastases of the cancer types or tumors described above.

The term "cancer" according to the invention also comprises cancer metastases. By "metastasis" is meant the spread of cancer cells from its original site to another part of the body. The formation of metastasis is a very complex process and depends on detachment of malignant cells from the primary tumor, invasion of the extracellular matrix, penetration of the endothelial basement membranes to enter the body cavity and vessels, and then, after being transported by the blood, infiltration of target organs. Finally, the growth of a new tumor, i.e. a secondary tumor or metastatic tumor, at the target site depends on angiogenesis. Tumor metastasis often occurs even after the removal of the primary tumor because tumor cells or components may remain and develop metastatic potential. In one embodiment, the term "metastasis" according to the invention relates to "distant metastasis" which relates to a metastasis which is remote from the primary tumor and the regional lymph node system.

The term "infectious disease" refers to any disease which can be transmitted from individual to individual or from organism to organism, and is caused by a microbial agent (e.g. common cold). Examples of infectious diseases include viral infectious diseases, such as AIDS (HIV), hepatitis A, B or C, herpes, herpes zoster (chicken-pox), German measles (rubella virus), yellow fever, dengue etc. flaviviruses, influenza viruses, hemorrhagic infectious diseases (Marburg or Ebola viruses), and severe acute respiratory syndrome (SARS), bacterial infectious diseases, such as Legionnaire's disease (*Legionella*), sexually transmitted diseases (e.g. *chlamydia* or gonorrhea), gastric ulcer (*Helicobacter*), cholera (*Vibrio*), tuberculosis, diphtheria, infections by *E. coli*, Staphylococci, *Salmonella* or Streptococci (tetanus); infections by protozoan pathogens such as malaria, sleeping sickness, leishmaniasis; toxoplasmosis, i.e. infections by *Plasmodium, Trypanosoma, Leishmania* and *Toxoplasma*; or fungal infections, which are caused, e.g., by *Cryptococcus neoformans, Histoplasma capsulatum, Coccidioides immitis, Blastomyces dermatitidis* or *Candida albicans*.

The term "inflammatory disease" refers to any disease, which is characterized by or associated with high levels of inflammation in tissues, in particular connective tissues, or degeneration of these tissues. A chronic inflammatory disease is a medical condition which is characterized by persistent inflammation. Examples of (chronic) inflammatory diseases include celiac disease, vasculitis, lupus, chronic obstructive pulmonary disease (COPD), irritable bowel disease, atherosclerosis, arthritis, ankylosing spondylitis, Crohn's disease, colitis, chronic active hepatitis, dermatitis and psoriasis.

The term "metabolic disease" refers to any disease or disorder that disrupts normal metabolism. Examples include cystinosis, diabetes, dyslipidemia, hyperthyroidism, hypothyroidism, hyperlipidemia, hypolipidemia, galactosemia, Gaucher's disease, obesity and phenylketonuria.

The term "autoimmune disorder" refers to any disease/disorder in which the body produces an immunogenic (i.e. immune system) response to some constituent of its own tissue. In other words, the immune system loses its ability to recognize some tissue or system within the body as self and targets and attacks it as if it were foreign. Autoimmune diseases can be classified into those in which predominantly one organ is affected (e.g. hemolytic anemia and anti-immune thyroiditis), and those in which the autoimmune disease process is diffused through many tissues (e.g. systemic lupus erythematosus). For example, multiple sclerosis is thought to be caused by T cells attacking the sheaths that surround the nerve fibers of the brain and spinal cord. This results in loss of coordination, weakness, and blurred vision. Autoimmune diseases are known in the art and include, for instance, Hashimoto's thyroiditis, Grave's disease, lupus, multiple sclerosis, rheumatic arthritis, hemolytic anemia, anti-immune thyroiditis, systemic lupus erythematosus, celiac disease, Crohn's disease, colitis, diabetes, scleroderma, psoriasis, and the like.

The term "degenerative disease" refers to any disease in which the function or structure of the affected tissues or organs will increasingly deteriorate over time. Examples include Alzheimer's disease, Parkinson's disease, amyotrophic lateral sclerosis (ALS), Huntington's disease, macular degeneration, multiple sclerosis, muscular dystrophy, Niemann Pick disease, osteoporosis and rheumatoid arthritis.

The term "apoptosis-associated diseases" refers to any disease in which alterations of apoptosis are involved. Examples include cancer, neurological disorders, such as Alzheimer's disease, Parkinson's disease, Huntington's disease, amyotrophic lateral sclerosis (ALS) and stroke, heart diseases, such as ischemia reperfusion and chronic heart failure, infectious diseases and autoimmune diseases.

The term "transplant rejection" refers to the rejection of a transplanted tissue or organ by the recipient's immune system, which may, ultimately, destroy the transplanted tissue or organ.

By "treat" is meant to administer a compound or composition or a combination of compounds or compositions to a subject in order to prevent or eliminate a disease, including reducing the size of a tumor or the number of tumors in a subject; arrest or slow a disease in a subject; inhibit or slow the development of a new disease in a subject; decrease the frequency or severity of symptoms and/or recurrences in a subject who currently has or who previously has had a disease; and/or prolong, i.e. increase the lifespan of the subject.

In particular, the term "treatment of a disease" includes curing, shortening the duration, ameliorating, preventing, slowing down or inhibiting progression or worsening, or preventing or delaying the onset of a disease or the symptoms thereof.

The term "subject" means according to the invention a subject for treatment, in particular a diseased subject (also referred to as "patient"), including human beings, non-human primates or other animals, in particular mammals, such as cows, horses, pigs, sheep, goats, dogs, cats, rabbits, guinea pigs, hamsters or rodents, such as mice and rats. In a particularly preferred embodiment, the subject/patient is a human being.

The agents and compositions provided herein may be used alone or in combination with therapeutic regimens.

EXAMPLES

Example 1: Generation of Agonistic Anti-CD27, Anti-CD134 and Anti-CD137 Antibodies 1.1 Immunization and Collection of B-Cell Clones 9 rabbits were immunized with a mixture of human CD27 (Enzo Life Sciences, ALX-522-031-0000), human CD134 (OX40; AdipoGen, AG-40B-0014) and human CD137 (4-1BB; Enzo Life Sciences, ALX-522-029-0000), wherein each protein was fused to the Fc portion of human IgG1. Blood was taken at 4 different time points and enriched for B-lymphocytes (also referred to as B-cells). Single B-cells were sorted by fluorescence-activated cell sorting (FACS) into wells of a 96-well microtiter plate and cultivated for 8 days, releasing antibodies into the cultivation medium. The B-cell supernatants were removed and prepared for testing.

1.2 Screening for Target-Binding Antibodies by ELISA

In order to identify antibodies that bind to human CD27, CD134 and CD137, respectively, an enzyme-linked immunosorbent assay (ELISA) was established. For this purpose, CD27 protein (His-tagged, Sino Biological Inc. 10039-H08B1), CD134 protein (His-tagged, Sino Biological Inc. 10481-H08H) and CD137 protein (His-tagged, Sino Biological Inc. 10041-H08H), respectively, were coated onto microtiter plates. PBS containing 2% BSA and 0.05% Tween was used for blocking. After incubation with B-cell supernatants, bound antibodies were detected by using a peroxidase-labeled anti-rabbit-Fc antibody.

Figure 1B:
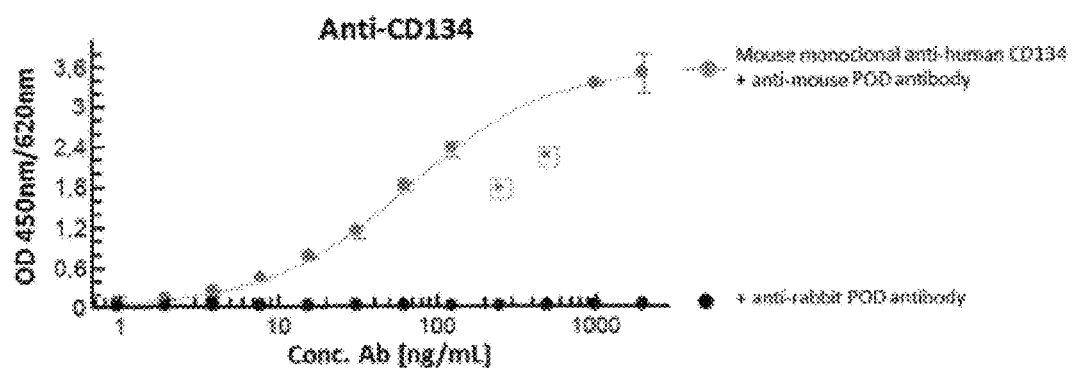
Figure 1C:
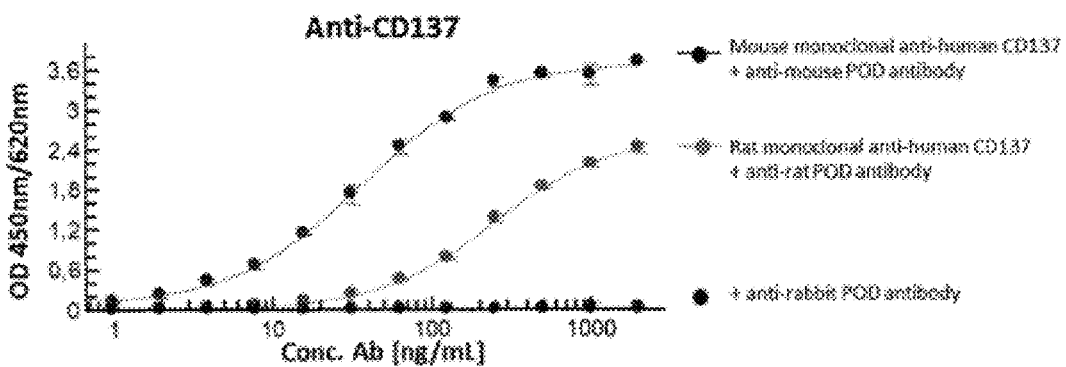

Commercially available antibodies were used as reference antibodies for assay development. FIG. 1A shows binding curves of reference anti-CD27 antibodies (Armenian hamster monoclonal anti-human CD27 clone LG7F9 and mouse monoclonal anti-human CD27 clone 0323, both purchased from eBiosciences) to recombinant protein. FIG. 1B shows binding curves of a reference anti-CD134 antibody (mouse monoclonal anti-human CD134 clone Ber-ACT35, purchased from eBiosciences) to recombinant protein. FIG. 1C shows binding curves of reference anti-CD137 antibodies (mouse anti-human CD137 clone 4B4-1 from Biolegend and rat monoclonal anti-human CD137 from Biozol BZL06614) to recombinant protein. For all three ELISAs, OD 450 nm/620 nm values >0.5 indicated binding, and the maximum value was at about 3.6.

In total, 47.471 B-cells were sorted, cultivated and screened for binding to CD27, CD134 and CD137 by ELISA. 5.096 antibodies were identified to bind to at least to one of the three targets.

1.3 Identification of Cell-Binding Antibodies

Figure 2A:
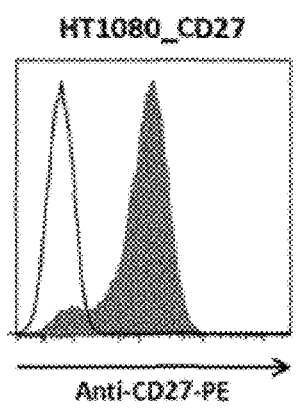
FIGS. 2A-2C show the expression of CD27, CD134 and CD137 on the cell surface of HT1080 cell lines overexpressing CD27, CD134 and CD137, respectively, as determined by fluorescence-activated cell sorting (FACS).
Figure 2B:
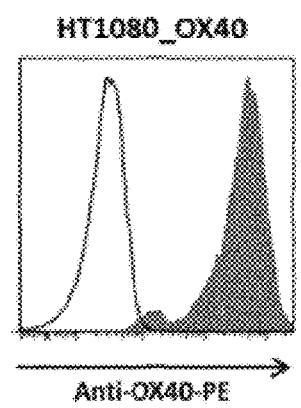
Figure 2C:
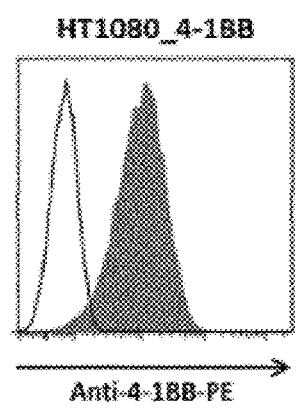

The 5.096 ELISA hits were then tested in a cellular binding assay for binding to cell surface expressed CD27, CD134 and CD137, respectively. For this purpose, the following stable transfectants of the HT1080 cell line were used: HT1080_CD27, HT1080_OX40 and HT1080_4-1BB. Cells were cultivated in RPMI 1640 GlutaMAX supplemented with 5% FCS, 100 IU/mL penicillin, and 100 µg/mL streptomycin. Cell surface expression of TNF receptors on HT1080-transfectants was analyzed by FACS, wherein cells were stained using antibodies against CD27-PE (BD), OX40-PE (BD) and 4-1BB-PE (BD) (FIGS. 2A-2C).

In order to test cellular binding of the antibodies, HT1080 cells overexpressing the respective target (1.000 cells per well of a 384-well microtiter plate) were incubated together with samples for 18 hours. After gentle washing, an Alexa-labeled detection antibody and Hoechst dye were added, and fluorescence intensity was read in the cell imager CellInsight (Thermo). Data analysis was based on the calculation of the mean object spot average intensity.

Figure 3A:
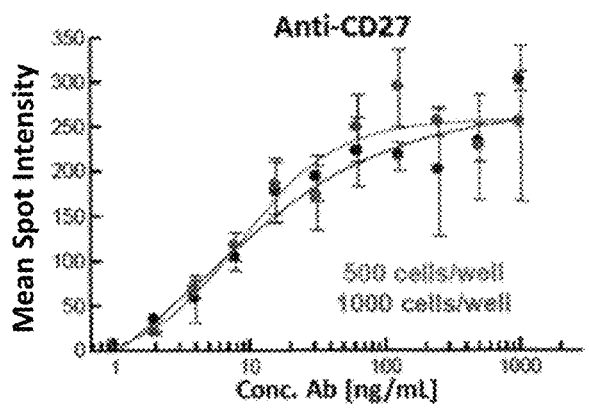
FIGS. 3A-3C show binding curves of reference antibodies against CD27, CD134 and CD137 to CD27, CD134 and CD137 expressed on the cell surface of corresponding HT1080 cell lines, as determined by a cellular binding assay.
Figure 3B:
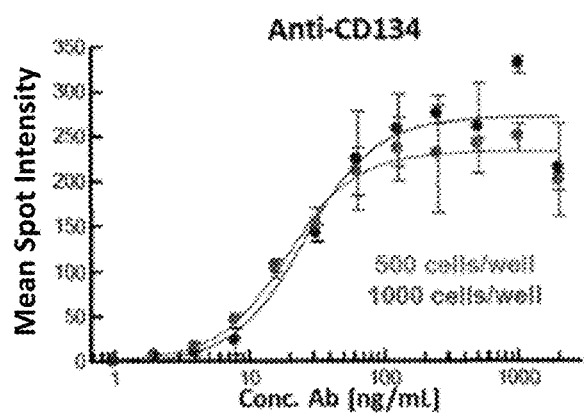
Figure 3C:
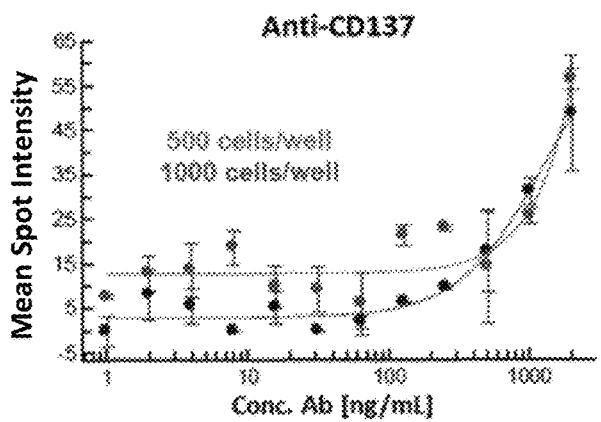

Commercially available antibodies were used as reference antibodies for assay development. FIG. 3A shows binding curves of reference anti-CD27 antibodies (Armenian hamster monoclonal anti-human CD27 clone LG7F9) to HT1080_CD27 cells. FIG. 3B shows binding curves of reference anti-CD134 antibodies (mouse monoclonal anti-human CD134 clone Ber-ACT35) to HT1080_OX40 cells. FIG. 3C shows binding curves of reference anti-CD137 antibodies (mouse anti-human CD137 clone 4B4-1) to HT1080_4-1BB cells. For all three cell lines, a mean spot intensity >25 indicated binding, and the maximum values were at about 300.

3.176 antibodies out of the 5.096 ELISA hits were identified to bind at least to one of the three cell surface expressed targets by the cellular binding assay.

1.4 Recombinant Antibody Production 644 antibody hits, identified by ELISA and the cellular binding assay as described above, were selected. These hits were picked, their RNA was extracted, and sequencing was performed. 582 unique sequences were identified, and the corresponding variable regions of heavy and light chains were gene synthesized. The variable regions were cloned in front of human immunoglobulin constant parts (IgG1/κ). HEK293 cell transient transfections protocols were executed by a Tecan Freedom Evo device on a Dionex Ultimate 3000 with a plate auto-sampler. After normalization, 531 antibodies were available for confirmation of the primary screening data set (ELISA, cellular binding) and for functional assays.

1.5 Analysis of Recombinantly Expressed Antibodies

In order to confirm the primary screening data set, all 531 recombinantly produced antibodies were retested (i) for their binding to the corresponding recombinant protein in the ELISA and (ii) for their binding to the corresponding target expressed on the cell surface of HT1080 cells in the cellular binding assay (both assays as described above).

Figure 4:
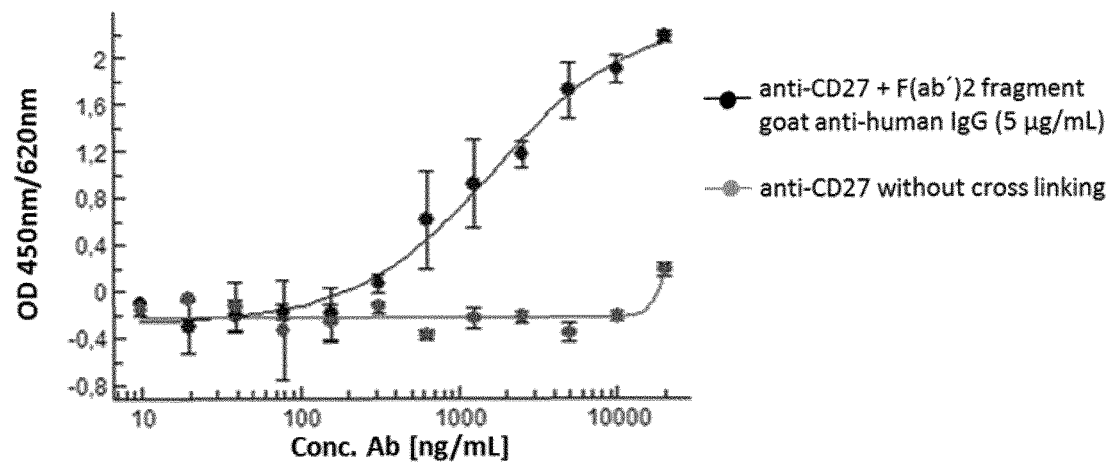
FIG. 4 shows the activation curve of an agonistic anti-CD27 reference antibody with or without cross-linking, as determined by ELISA measuring the IL-8 concentration in the supernatants of CD27-overexpressing HT1080 cells.

Furthermore, for the analysis of agonistic antibody functions, target-overexpressing HT1080 cells were used, wherein stimulation of the targets (CD27, CD134 and CD137, respectively) induced IL-8 release from these cell lines. The recombinant CD27-, CD134- and CD137-over-expressing HT1080 cells (5.000 cells per well of a 384-well microtiter plate) were incubated for 6 hours at 37° C. with the antibody samples. IL-8 concentrations in the supernatants were then determined by using an IL-8 ELISA kit (BD Bioscience). In a second approach, antibodies were cross-linked. Therefor, the target-overexpressing HT1080 cells were incubated with a mixture of the antibody sample and a F(ab')2 fragment goat anti-human IgG (Dianova). An agonistic reference anti-CD27 antibody [described in US 2013/0183316 A1 (sequences 3 and 4, hCD27.15)] was used for assay development. FIG. 4 shows results of the IL-8 ELISA upon antibody titration with and without cross-linking. For all three IL-8 ELISAs, OD 450 nm/620 nm values >0.5 indicated agonistic antibody activities, the maximum values being at about 3.

Altogether, 186 agonistic anti-CD27 antibodies, 92 agonistic anti-CD134 antibodies and 12 agonistic anti-CD137 antibodies were identified by the functional assay under cross-linking conditions. To some extent, antibodies already showed agonistic activity without cross-linking. The data of the ELISAs, the cellular binding assays and the functional assays are summarized in Table 1 for the agonistic anti-CD27 antibodies, in Table 2 for the agonistic anti-CD134 antibodies and in Table 3 for the agonistic anti-CD137 antibodies.

Figure 5A:
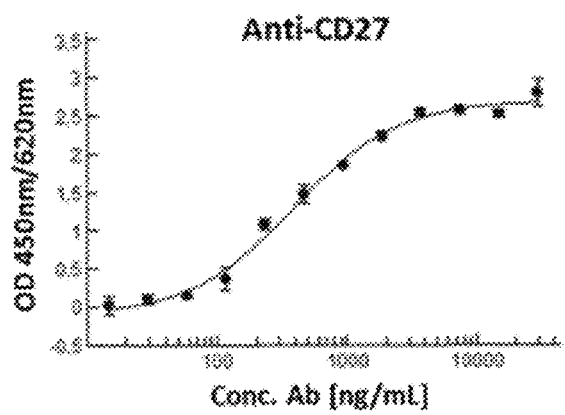
FIGS. 5A-5C show exemplary activation curves of agonistic anti-CD27, anti-CD134 and anti-CD137 antibodies under cross-linking conditions, as determined by ELISA measuring the IL-8 concentration in the supernatants of target-overexpressing HT1080 cells.
Figure 5B:
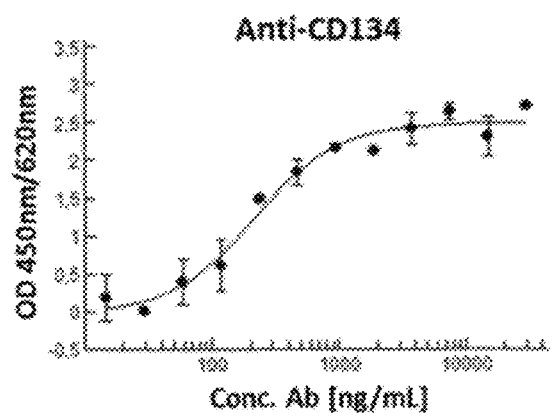
Figure 5C:
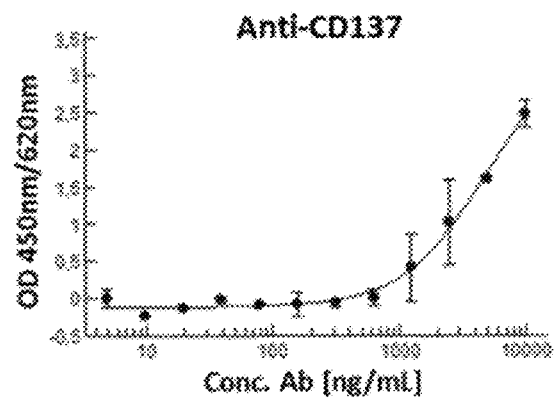

EC50 values of the agonistic function of anti-CD27, anti-CD134 and anti-CD137, respectively, upon cross-linking were determined by measuring IL-8 release values of 12 different antibody concentrations applied in the above-described functional assay. The EC50 value was calculated using Xlfit-analysis tools (Fit Models 205). Resulting typical sigmoidal curve progression is exemplarily shown in FIGS. 5A-5C for one anti-CD27 antibody (P018.S09.A.A06; EC50: 387.2 ng/mL), for one anti-CD134 antibody (P018.S02.A.H03; EC50: 214.9 ng/mL) and for one anti-CD137 antibody (P018.S08.A.E03; EC50: 4963.8 ng/mL). EC50 values of the antibodies are listed in Table 4 (anti-CD27), Table 5 (anti-CD134) and Table 6 (anti-CD137).

Sequence information of the tested antibodies are listed in Table 7 (anti-CD27), Table 8 (anti-CD134) as well as Table 9 (anti-CD137), wherein the sequences of the CDR regions are given according to the IMGT unique numbering scheme for V- and V-like-domains (Lefranc, M.-P., The Immunologist, 7, 132-136 (1999)).

TABLE 1

Binding and functional activity properties of agonistic anti-CD27 antibodies

| Anti-CD27 Antibody ID | ELISA [abs. corr.] | Cellular binding assay [RFU] | Functional assay IL-8 [abs. corr.] | Cross-linked by F(ab')2 fragment IL-8 [abs. corr.] |
|---|---|---|---|---|
| P018.S.01.A.G04 | 3.765 | 388 | 0.273 | 1.145 |
| P018.S.04.A.D04 | 3.696 | 365 | 0.486 | 1.322 |
| P018.S.01.A.G02 | 3.673 | 363 | 0.848 | 1.878 |
| P018.S.07.A.B04 | 3.635 | 382 | 0.304 | 1.667 |
| P018.S.06.A.B03 | 3.594 | 424 | 0.566 | 1.220 |
| P018.S.03.A.H04 | 3.589 | 334 | 0.211 | 1.226 |
| P018.S.08.A.H02 | 3.576 | 352 | 0.328 | 1.909 |
| P018.S.09.A.H03 | 3.536 | 268 | 0.578 | 2.130 |
| P018.S.09.A.E06 | 3.535 | 307 | 1.228 | 1.733 |
| P018.S.09.A.C03 | 3.533 | 319 | 0.464 | 2.253 |
| P018.S.07.A.F03 | 3.528 | 380 | 0.444 | 1.413 |
| P018.S.03.A.C04 | 3.524 | 337 | 0.394 | 1.483 |

TABLE 1-continued

Binding and functional activity properties of agonistic anti-CD27 antibodies

| Anti-CD27 Antibody ID | ELISA [abs. corr.] | Cellular binding assay [RFU] | IL-8 [abs. corr.] | Cross-linked by F(ab')2 fragment IL-8 [abs. corr.] |
|---|---|---|---|---|
| P018.S.09.A.E05 | 3.523 | 353 | 0.872 | 2.169 |
| P018.S.04.A.E02 | 3.516 | 463 | 0.676 | 1.911 |
| P018.S.01.A.B05 | 3.503 | 376 | 0.453 | 1.882 |
| P018.S.04.A.B05 | 3.502 | 414 | 0.308 | 1.084 |
| P018.S.01.A.G03 | 3.495 | 358 | −0.105 | 1.214 |
| P018.S.10.A.F05 | 3.491 | 335 | 0.267 | 1.341 |
| P018.S.02.A.B05 | 3.485 | 374 | 0.201 | 1.761 |
| P018.S.04.A.G04 | 3.479 | 335 | 0.451 | 1.571 |
| P018.S.07.A.H02 | 3.471 | 283 | 0.107 | 1.222 |
| P018.S.05.A.H02 | 3.469 | 336 | 0.369 | 1.899 |
| P018.S.03.A.F02 | 3.464 | 276 | 0.736 | 1.221 |
| P018.S.04.A.H04 | 3.463 | 291 | 0.579 | 1.982 |
| P018.S.07.A.C04 | 3.453 | 300 | 0.302 | 1.645 |
| P018.S.09.A.C06 | 3.452 | 219 | 1.943 | 2.304 |
| P018.S.01.A.E06 | 3.446 | 291 | 0.448 | 1.401 |
| P018.S.01.A.H06 | 3.445 | 422 | 0.270 | 2.181 |
| P018.S.07.A.A05 | 3.441 | 379 | 0.408 | 1.033 |
| P018.S.02.A.F05 | 3.440 | 307 | 0.395 | 1.165 |
| P018.S.03.A.A02 | 3.438 | 373 | 0.651 | 2.203 |
| P018.S.03.A.G02 | 3.435 | 275 | 0.412 | 1.280 |
| P018.S.10.A.G05 | 3.424 | 408 | 0.137 | 1.249 |
| P018.S.08.A.D01 | 3.421 | 394 | −0.001 | 1.120 |
| P018.S.01.A.F02 | 3.420 | 326 | 0.495 | 2.052 |
| P018.S.07.A.B05 | 3.418 | 295 | 0.203 | 1.407 |
| P018.S.10.A.H01 | 3.418 | 443 | 0.412 | 2.288 |
| P018.S.08.A.A01 | 3.417 | 448 | 0.876 | 1.570 |
| P018.S.04.A.D02 | 3.416 | 335 | 0.294 | 1.346 |
| P018.S.03.A.B02 | 3.411 | 308 | 0.366 | 1.489 |
| P018.S.06.A.A03 | 3.411 | 387 | 0.576 | 1.861 |
| P018.S.02.A.G01 | 3.408 | 332 | 0.127 | 1.518 |
| P018.S.01.A.D04 | 3.405 | 341 | 0.175 | 2.199 |
| P018.S.07.A.H04 | 3.403 | 386 | 0.158 | 1.864 |
| P018.S.03.A.G06 | 3.402 | 302 | 0.560 | 1.364 |
| P018.S.06.A.F01 | 3.402 | 310 | 0.405 | 1.082 |
| P018.S.10.A.C06 | 3.390 | 395 | 0.280 | 1.175 |
| P018.S.04.A.B01 | 3.383 | 330 | 0.508 | 1.670 |
| P018.S.04.A.E04 | 3.381 | 283 | 0.641 | 1.344 |
| P018.S.02.A.H05 | 3.375 | 252 | 0.067 | 1.403 |
| P018.S.04.A.C02 | 3.373 | 415 | 0.235 | 1.534 |
| P018.S.09.A.D02 | 3.373 | 337 | 1.013 | 1.746 |
| P018.S.08.A.D02 | 3.372 | 407 | 0.534 | 1.668 |
| P018.S.05.A.D04 | 3.372 | 317 | 0.246 | 1.527 |
| P018.S.03.A.D02 | 3.370 | 397 | 0.463 | 1.469 |
| P018.S.07.A.B03 | 3.369 | 346 | 0.612 | 1.340 |
| P018.S.02.A.C06 | 3.366 | 348 | 0.418 | 1.590 |
| P018.S.01.A.B04 | 3.362 | 382 | 0.582 | 2.121 |
| P018.S.03.A.C02 | 3.362 | 317 | 0.373 | 1.582 |
| P018.S.03.A.H05 | 3.359 | 294 | 0.401 | 1.391 |
| P018.S.09.A.H04 | 3.356 | 314 | 0.274 | 1.399 |
| P018.S.04.A.F04 | 3.355 | 320 | 1.600 | 2.494 |
| P018.S.05.A.E04 | 3.354 | 332 | 0.813 | 1.329 |
| P018.S.07.A.B06 | 3.353 | 372 | 0.218 | 1.074 |
| P018.S.05.A.C06 | 3.351 | 351 | 0.539 | 1.111 |
| P018.S.07.A.F04 | 3.351 | 296 | 0.424 | 1.582 |
| P018.S.01.A.F05 | 3.350 | 369 | 0.559 | 1.180 |
| P018.S.05.A.G04 | 3.349 | 375 | 0.393 | 1.191 |
| P018.S.09.A.D04 | 3.348 | 376 | 0.688 | 1.660 |
| P018.S.07.A.H06 | 3.345 | 327 | 0.422 | 1.228 |
| P018.S.06.A.E01 | 3.345 | 354 | 0.525 | 1.551 |
| P018.S.07.A.D03 | 3.340 | 409 | 0.569 | 1.676 |
| P018.S.07.A.D04 | 3.335 | 393 | 0.449 | 1.810 |
| P018.S.08.A.E02 | 3.333 | 387 | 0.315 | 1.555 |
| P018.S.04.A.D05 | 3.331 | 292 | 0.241 | 1.081 |
| P018.S.07.A.G02 | 3.330 | 453 | 0.725 | 2.408 |
| P018.S.02.A.E06 | 3.324 | 331 | 0.308 | 1.292 |
| P018.S.03.A.C05 | 3.321 | 303 | 0.544 | 1.630 |
| P018.S.04.A.A01 | 3.319 | 297 | 0.176 | 1.471 |
| P018.S.05.A.B02 | 3.318 | 259 | 0.633 | 1.954 |
| P018.S.08.A.G02 | 3.316 | 315 | 0.598 | 2.483 |
| P018.S.03.A.F04 | 3.307 | 299 | 0.253 | 1.593 |
| P018.S.10.A.F01 | 3.306 | 329 | −0.011 | 1.052 |
| P018.S.10.A.G03 | 3.306 | 386 | −0.180 | 1.300 |
| P018.S.01.A.B03 | 3.304 | 387 | 0.060 | 1.699 |

TABLE 1-continued

Binding and functional activity properties of agonistic anti-CD27 antibodies

| Anti-CD27 Antibody ID | ELISA [abs. corr.] | Cellular binding assay [RFU] | Functional assay IL-8 [abs. corr.] | Cross-linked by F(ab')2 fragment IL-8 [abs. corr.] |
|---|---|---|---|---|
| P018.S.05.A.A02 | 3.301 | 334 | 0.212 | 1.534 |
| P018.S.05.A.A04 | 3.301 | 369 | 0.226 | 1.371 |
| P018.S.06.A.E02 | 3.299 | 357 | 0.582 | 1.223 |
| P018.S.10.A.E01 | 3.298 | 227 | 0.257 | 2.544 |
| P018.S.01.A.E03 | 3.297 | 335 | 0.436 | 1.220 |
| P018.S.01.A.H02 | 3.296 | 317 | 0.300 | 2.536 |
| P018.S.01.A.C06 | 3.296 | 369 | 0.325 | 1.788 |
| P018.S.05.A.F02 | 3.294 | 472 | 0.526 | 1.913 |
| P018.S.03.A.E04 | 3.294 | 356 | 0.200 | 1.193 |
| P018.S.04.A.A05 | 3.294 | 206 | 1.666 | 2.238 |
| P018.S.07.A.C06 | 3.293 | 336 | 0.408 | 1.044 |
| P018.S.09.A.D05 | 3.282 | 400 | 0.187 | 2.109 |
| P018.S.10.A.E06 | 3.281 | 215 | 0.262 | 2.061 |
| P018.S.06.A.D04 | 3.280 | 394 | 0.444 | 1.064 |
| P018.S.01.A.E04 | 3.280 | 295 | 0.264 | 1.149 |
| P018.S.07.A.E03 | 3.276 | 227 | 0.123 | 1.513 |
| P018.S.04.A.B03 | 3.276 | 338 | 0.394 | 1.971 |
| P018.S.09.A.E03 | 3.272 | 334 | 0.099 | 1.545 |
| P018.S.02.A.D04 | 3.269 | 390 | 0.569 | 1.369 |
| P018.S.01.A.D02 | 3.258 | 323 | 0.675 | 1.667 |
| P018.S.10.A.B06 | 3.254 | 308 | 0.455 | 1.461 |
| P018.S.10.A.H02 | 3.252 | 144 | 1.573 | 2.104 |
| P018.S.02.A.B03 | 3.251 | 332 | 0.120 | 1.161 |
| P018.S.01.A.C02 | 3.250 | 324 | 0.395 | 1.478 |
| P018.S.07.A.H05 | 3.248 | 256 | −0.160 | 1.186 |
| P018.S.01.A.A04 | 3.244 | 315 | 0.236 | 1.030 |
| P018.S.01.A.C04 | 3.243 | 368 | 0.383 | 1.081 |
| P018.S.02.A.F06 | 3.240 | 294 | 0.094 | 1.728 |
| P018.S.06.A.H04 | 3.234 | 331 | 0.173 | 1.692 |
| P018.S.06.A.C02 | 3.232 | 283 | 0.519 | 1.610 |
| P018.S.06.A.A02 | 3.232 | 366 | 0.737 | 1.811 |
| P018.S.02.A.A01 | 3.225 | 350 | 0.400 | 1.616 |
| P018.S.01.A.E05 | 3.222 | 420 | 0.209 | 1.332 |
| P018.S.03.A.D03 | 3.216 | 320 | 0.281 | 1.051 |
| P018.S.08.A.A03 | 3.214 | 342 | 0.276 | 1.639 |
| P018.S.10.A.C03 | 3.214 | 360 | 0.079 | 1.561 |
| P018.S.03.A.G03 | 3.207 | 292 | 0.546 | 1.585 |
| P018.S.07.A.E05 | 3.198 | 317 | 0.055 | 1.151 |
| P018.S.03.A.D06 | 3.194 | 360 | 0.245 | 1.053 |
| P018.S.01.A.C05 | 3.189 | 349 | 0.327 | 1.400 |
| P018.S.02.A.G04 | 3.188 | 196 | 0.205 | 1.674 |
| P018.S.10.A.B01 | 3.187 | 333 | 0.080 | 1.037 |
| P018.S.10.A.A06 | 3.181 | 414 | −0.130 | 1.121 |
| P018.S.06.A.F04 | 3.176 | 338 | 0.678 | 1.160 |
| P018.S.09.A.A05 | 3.173 | 214 | 0.504 | 1.953 |
| P018.S.04.A.C05 | 3.173 | 292 | 0.382 | 1.429 |
| P018.S.01.A.G06 | 3.171 | 313 | 0.491 | 1.088 |
| P018.S.06.A.F06 | 3.170 | 326 | 0.700 | 1.030 |
| P018.S.09.A.A03 | 3.160 | 360 | 0.263 | 1.542 |
| P018.S.06.A.E04 | 3.160 | 281 | 0.327 | 1.223 |
| P018.S.06.A.F03 | 3.157 | 304 | 0.063 | 1.082 |
| P018.S.07.A.G04 | 3.156 | 177 | 0.274 | 1.741 |
| P018.S.10.A.E04 | 3.154 | 280 | 0.339 | 2.287 |
| P018.S.03.A.H02 | 3.152 | 395 | 0.130 | 1.071 |
| P018.S.03.A.H03 | 3.152 | 289 | 0.588 | 1.093 |
| P018.S.03.A.F03 | 3.151 | 223 | 0.106 | 1.355 |
| P018.S.01.A.A05 | 3.148 | 300 | 0.328 | 1.086 |
| P018.S.06.A.C03 | 3.143 | 269 | 0.272 | 1.131 |
| P018.S.10.A.C05 | 3.143 | 11 | 0.206 | 2.098 |
| P018.S.01.A.D05 | 3.140 | 273 | 0.089 | 1.101 |
| P018.S.03.A.B05 | 3.137 | 206 | 0.325 | 1.213 |
| P018.S.10.A.A04 | 3.132 | 175 | 1.778 | 2.159 |
| P018.S.06.A.C06 | 3.132 | 379 | 0.128 | 1.078 |
| P018.S.02.A.G03 | 3.129 | 357 | −0.061 | 1.484 |
| P018.S.07.A.C02 | 3.128 | 380 | 0.735 | 2.020 |
| P018.S.02.A.A06 | 3.126 | 293 | 0.299 | 1.476 |
| P018.S.01.A.E02 | 3.126 | 360 | 0.276 | 1.172 |
| P018.S.09.A.F05 | 3.125 | 400 | 0.158 | 1.683 |
| P018.S.09.A.G06 | 3.120 | 338 | 0.467 | 1.338 |
| P018.S.03.A.D05 | 3.118 | 324 | 0.500 | 1.504 |
| P018.S.10.A.B02 | 3.114 | 249 | 0.470 | 1.907 |
| P018.S.04.A.E05 | 3.111 | 319 | 0.747 | 1.766 |
| P018.S.05.A.A06 | 3.107 | 374 | 0.324 | 1.582 |

TABLE 1-continued

Binding and functional activity properties of agonistic anti-CD27 antibodies

|  | Cellular binding | | Functional assay | |
|---|---|---|---|---|
| Anti-CD27 Antibody ID | ELISA [abs. corr.] | assay [RFU] | IL-8 [abs. corr.] | Cross-linked by F(ab')2 fragment IL-8 [abs. corr.] |
| P018.S.05.A.D03 | 3.105 | 321 | 0.100 | 1.278 |
| P018.S.08.A.F01 | 3.102 | 395 | 0.211 | 1.113 |
| P018.S.05.A.B06 | 3.098 | 309 | 0.220 | 1.700 |
| P018.S.03.A.D04 | 3.098 | 270 | 0.513 | 1.230 |
| P018.S.01.A.A06 | 3.091 | 287 | 0.566 | 1.919 |
| P018.S.09.A.A06 | 3.088 | 113 | 2.192 | 2.251 |
| P018.S.07.A.A02 | 3.081 | 314 | 0.059 | 1.852 |
| P018.S.07.A.D05 | 3.080 | 329 | −0.032 | 1.639 |
| P018.S.05.A.E03 | 3.069 | 322 | 0.208 | 1.915 |
| P018.S.10.A.E02 | 3.016 | 395 | 0.230 | 1.389 |
| P018.S.03.A.G05 | 2.981 | 269 | 0.031 | 1.272 |
| P018.S.09.A.E02 | 2.981 | 305 | 0.172 | 1.610 |
| P018.S.09.A.F06 | 2.980 | 218 | 0.580 | 2.032 |
| P018.S.06.A.H05 | 2.977 | 308 | 0.278 | 1.557 |
| P018.S.10.A.H05 | 2.961 | 313 | −0.155 | 1.108 |
| P018.S.06.A.A05 | 2.954 | 140 | 0.433 | 1.086 |
| P018.S.09.A.A02 | 2.949 | 155 | 0.839 | 2.458 |
| P018.S.09.A.C02 | 2.943 | 323 | 0.070 | 1.068 |
| P018.S.06.A.B01 | 2.943 | 279 | 0.106 | 1.176 |
| P018.S.10.A.C01 | 2.934 | 266 | −0.046 | 1.104 |
| P018.S.05.A.D06 | 2.931 | 323 | 0.338 | 1.228 |
| P018.S.02.A.B01 | 2.930 | 332 | 0.538 | 1.423 |
| P018.S.10.A.C02 | 2.905 | 238 | 0.631 | 2.284 |
| P018.S.10.A.F04 | 2.889 | 133 | 0.273 | 2.324 |
| P018.S.10.A.A03 | 2.806 | 198 | 1.021 | 2.063 |
| P018.S.05.A.F05 | 2.310 | 11 | 0.189 | 2.212 |
| P018.S.10.A.B03 | 2.243 | 19 | −0.032 | 2.074 |

TABLE 2

Binding and functional activity properties of agonistic anti-CD134 antibodies

|  | Cellular binding | | Functional assay | |
|---|---|---|---|---|
| Anti-CD134 Antibody ID | ELISA [abs. corr.] | assay [RFU] | IL-8 [abs. corr.] | Cross-linked by F(ab')2 fragment IL-8 [abs. corr.] |
| P018.S.03.A.E03 | 2.718 | 419 | 0.314 | 2.544 |
| P018.S.04.A.G05 | 2.865 | 451 | −0.022 | 2.414 |
| P018.S.04.A.F05 | 2.439 | 368 | 0.181 | 2.397 |
| P018.S.05.A.G03 | 0.056 | 40 | 0.032 | 2.391 |
| P018.S.05.A.G05 | 2.619 | 463 | 2.616 | 2.387 |
| P018.S.04.A.H05 | 2.972 | 451 | 0.356 | 2.386 |
| P018.S.04.A.E06 | 0.206 | 140 | 0.135 | 2.381 |
| P018.S.02.A.F01 | 2.690 | 498 | 0.115 | 2.341 |
| P018.S.04.A.D06 | 2.493 | 510 | 1.009 | 2.302 |
| P018.S.04.A.B06 | 2.638 | 482 | 1.824 | 2.271 |
| P018.S.12.A.E04 | 2.208 | 659 | 0.455 | 2.234 |
| P018.S.04.A.A06 | 2.853 | 486 | 0.879 | 2.211 |
| P018.S.04.A.F06 | 2.358 | 402 | 2.071 | 2.210 |
| P018.S.11.A.C04 | 1.963 | 406 | 0.253 | 2.195 |
| P018.S.12.A.H05 | 2.373 | 527 | 0.348 | 2.190 |
| P018.S.12.A.G05 | 2.045 | 570 | 0.130 | 2.190 |
| P018.S.11.A.C03 | 1.535 | 507 | 0.586 | 2.189 |
| P018.S.12.A.D06 | 0.865 | 180 | 0.832 | 2.171 |
| P018.S.12.A.F05 | 2.124 | 511 | 0.341 | 2.165 |
| P018.S.11.A.A06 | 1.845 | 537 | 0.732 | 2.164 |
| P018.S.11.A.F05 | 1.669 | 396 | 0.330 | 2.155 |
| P018.S.12.A.F03 | 2.450 | 485 | 0.527 | 2.153 |
| P018.S.12.A.D05 | 2.130 | 451 | −0.007 | 2.152 |
| P018.S.11.A.A05 | 1.898 | 550 | 0.260 | 2.149 |
| P018.S.12.A.B05 | 2.103 | 536 | 0.960 | 2.147 |
| P018.S.12.A.C02 | 2.052 | 571 | 0.936 | 2.143 |
| P018.S.12.A.A01 | 2.414 | 600 | 0.071 | 2.137 |
| P018.S.11.A.F04 | 2.251 | 486 | 0.568 | 2.113 |
| P018.S.04.A.B04 | 3.208 | 331 | 1.990 | 2.112 |
| P018.S.12.A.C03 | 1.956 | 483 | 0.238 | 2.108 |
| P018.S.12.A.B01 | 2.341 | 607 | 0.396 | 2.107 |
| P018.S.12.A.E05 | 1.933 | 523 | 0.132 | 2.107 |
| P018.S.12.A.G03 | 2.521 | 452 | 0.209 | 2.105 |

TABLE 2-continued

Binding and functional activity properties of agonistic anti-CD134 antibodies

| Anti-CD134 Antibody ID | Cellular binding | | Functional assay | |
|---|---|---|---|---|
| | ELISA [abs. corr.] | assay [RFU] | IL-8 [abs. corr.] | Cross-linked by F(ab')2 fragment IL-8 [abs. corr.] |
| P018.S.11.A.B06 | 2.133 | 441 | 0.403 | 2.105 |
| P018.S.11.A.B03 | 2.660 | 527 | −0.075 | 2.104 |
| P018.S.12.A.C06 | 2.346 | 525 | 0.881 | 2.101 |
| P018.S.11.A.G03 | 2.112 | 450 | 1.573 | 2.101 |
| P018.S.12.A.B06 | 1.404 | 451 | 1.845 | 2.071 |
| P018.S.11.A.G02 | 1.070 | 357 | 0.270 | 2.061 |
| P018.S.12.A.C01 | 2.493 | 496 | −0.026 | 2.058 |
| P018.S.12.A.B03 | 1.182 | 446 | 1.074 | 2.054 |
| P018.S.11.A.G05 | 2.363 | 531 | 0.031 | 2.053 |
| P018.S.12.A.F06 | 1.645 | 500 | 0.374 | 2.052 |
| P018.S.12.A.A06 | 1.613 | 515 | 0.062 | 2.043 |
| P018.S.11.A.D04 | 2.070 | 530 | 0.380 | 2.043 |
| P018.S.11.A.E02 | 2.652 | 525 | 0.214 | 2.043 |
| P018.S.12.A.E01 | 2.547 | 463 | 0.439 | 2.038 |
| P018.S.11.A.A03 | 1.930 | 459 | 1.381 | 2.011 |
| P018.S.11.A.H05 | 1.691 | 478 | 1.207 | 2.010 |
| P018.S.04.A.C06 | 2.501 | 458 | 0.538 | 2.005 |
| P018.S.12.A.E03 | 2.043 | 482 | 0.461 | 2.005 |
| P018.S.12.A.G04 | 2.082 | 534 | 0.407 | 1.994 |
| P018.S.11.A.A04 | 2.105 | 582 | 0.533 | 1.993 |
| P018.S.12.A.F02 | 2.074 | 549 | 0.185 | 1.991 |
| P018.S.11.A.D06 | 0.744 | 130 | 0.019 | 1.966 |
| P018.S.12.A.B02 | 2.208 | 560 | −0.167 | 1.966 |
| P018.S.02.A.H03 | 0.468 | 198 | 2.557 | 1.954 |
| P018.S.11.A.H06 | 2.516 | 498 | 0.567 | 1.949 |
| P018.S.12.A.F04 | 2.109 | 551 | 0.289 | 1.946 |
| P018.S.12.A.A03 | 1.440 | 493 | 0.393 | 1.945 |
| P018.S.11.A.F03 | 1.852 | 522 | 0.380 | 1.936 |
| P018.S.08.A.B03 | 2.661 | 477 | 0.709 | 1.935 |
| P018.S.12.A.H04 | 1.984 | 295 | −0.121 | 1.889 |
| P018.S.12.A.E06 | 2.302 | 493 | 0.054 | 1.866 |
| P018.S.12.A.D04 | 2.227 | 488 | 0.139 | 1.865 |
| P018.S.12.A.G01 | 1.560 | 526 | 1.326 | 1.862 |
| P018.S.11.A.D03 | 1.993 | 482 | 2.243 | 1.861 |
| P018.S.11.A.E04 | 1.314 | 416 | −0.194 | 1.834 |
| P018.S.12.A.H01 | 1.888 | 523 | 0.430 | 1.834 |
| P018.S.12.A.D03 | 1.345 | 559 | 0.707 | 1.830 |
| P018.S.12.A.C04 | 2.044 | 509 | 0.215 | 1.829 |
| P018.S.11.A.B05 | 1.651 | 456 | 1.360 | 1.826 |
| P018.S.12.A.G02 | 2.331 | 530 | 0.212 | 1.806 |
| P018.S.11.A.H02 | 2.802 | 515 | 0.783 | 1.803 |
| P018.S.11.A.E03 | 0.276 | 318 | 0.481 | 1.791 |
| P018.S.12.A.D02 | 2.642 | 472 | 0.333 | 1.773 |
| P018.S.11.A.G04 | 2.128 | 482 | 0.014 | 1.752 |
| P018.S.02.A.F03 | 2.851 | 140 | 0.090 | 1.732 |
| P018.S.11.A.E06 | 2.047 | 554 | 0.278 | 1.722 |
| P018.S.05.A.F05 | 2.411 | 392 | 0.187 | 1.711 |
| P018.S.11.A.B04 | 1.426 | 444 | −0.087 | 1.657 |
| P018.S.12.A.C05 | 2.941 | 494 | 0.228 | 1.653 |
| P018.S.12.A.E02 | 2.589 | 497 | 0.355 | 1.629 |
| P018.S.11.A.H04 | 2.648 | 382 | 0.610 | 1.612 |
| P018.S.13.A.G06 | 0.002 | 0 | −0.114 | 1.585 |
| P018.S.12.A.A02 | 1.577 | 502 | 0.145 | 1.569 |
| P018.S.12.A.A05 | 2.862 | 503 | 0.267 | 1.526 |
| P018.S.11.A.E05 | 1.660 | 407 | −0.265 | 1.422 |
| P018.S.04.A.E01 | 2.876 | 22 | 0.084 | 1.405 |
| P018.S.12.A.A04 | 1.985 | 514 | −0.007 | 1.401 |
| P018.S.11.A.F02 | 2.426 | 503 | −0.011 | 1.382 |
| P018.S.12.A.H03 | 2.477 | 496 | −0.074 | 1.275 |
| P018.S.04.A.F04 | 0.000 | 11 | −0.129 | 1.132 |

TABLE 3

Binding and functional activity properties of agonistic anti-CD137 antibodies

| Anti-CD137 Antibody ID | Cellular binding ELISA [abs. corr.] | assay [RFU] | Functional assay IL-8 [abs. corr.] | Cross-linked by F(ab')2 fragment IL-8 [abs. corr.] |
|---|---|---|---|---|
| P018.S.13.A.A05 | 0.687 | 0 | 0.559 | 2.570 |
| P018.S.14.A.H01 | 2.968 | 6 | 2.015 | 2.193 |
| P018.S.08.A.E03 | 3.047 | 9 | −0.304 | 2.019 |
| P018.S.13.A.G04 | 0.577 | 1 | −0.179 | 1.801 |
| P018.S.13.A.A06 | 3.388 | 38 | −0.153 | 1.712 |
| P018.S.08.A.A04 | 3.418 | 46 | 0.368 | 1.546 |
| P018.S.14.A.D06 | 2.896 | 1 | −0.011 | 1.523 |
| P018.S.13.A.C02 | 2.551 | 8 | 0.113 | 1.399 |
| P018.S.08.A.F03 | 2.330 | 7 | −0.346 | 1.356 |
| P018.S.14.A.G03 | 2.072 | 19 | 0.222 | 1.140 |
| P018.S.14.A.A04 | 3.440 | 81 | 0.785 | 0.972 |
| P018.S.13.A.G03 | 1.725 | 13 | −0.164 | 0.789 |

TABLE 4

EC50 values of agonistic anti-CD27 antibodies

| Anti-CD27 Antibody ID | EC 50 [ng/mL] |
|---|---|
| P018.S.10.A.H02 | 122.2 |
| P018.S.09.A.A02 | 144.1 |
| P018.S.09.A.C06 | 220.9 |
| P018.S.10.A.E04 | 233.6 |
| P018.S.09.A.H06 | 329.1 |
| P018.S.10.A.A04 | 334.7 |
| P018.S.10.A.C05 | 340.1 |
| P018.S.05.A.F05 | 376.4 |
| P018.S.09.A.H03 | 387.0 |
| P018.S.09.A.A06 | 387.2 |
| P018.S.04.A.A05 | 407.7 |
| P018.S.10.A.C02 | 414.3 |
| P018.S.07.A.G02 | 430.4 |
| P018.S.10.A.H01 | 431.0 |
| P018.S.09.A.E05 | 502.0 |
| P018.S.10.A.A03 | 512.8 |
| P018.S.02.A.G03 | 526.1 |
| P018.S.09.A.D05 | 561.2 |
| P018.S.06.A.A02 | 575.3 |
| P018.S.10.A.E01 | 721.5 |
| P018.S.07.A.C04 | 801.5 |
| P018.S.04.A.A04 | 819.8 |
| P018.S.03.A.A02 | 834.9 |
| P018.S.01.A.B04 | 855.7 |
| P018.S.09.A.C03 | 1022.1 |
| P018.S.01.A.H02 | 1109.2 |
| P018.S.10.A.F04 | 1266.5 |
| P018.S.01.A.D04 | 1302.2 |
| P018.S.01.A.F05 | 1322.3 |
| P018.S.04.A.F04 | 1444.2 |
| P018.S.08.A.G02 | 1935.4 |
| P018.S.10.A.B03 | 1936.1 |
| P018.S.01.A.H06 | 2346.5 |

TABLE 5

EC50 values of agonistic anti-CD134 antibodies

| Anti-CD134 Antibody ID | EC 50 [ng/mL] |
|---|---|
| P018.S.12.A.B05 | 102.1 |
| P018.S.11.A.D03 | 175.8 |
| P018.S.02.A.H03 | 214.9 |
| P018.S.11.A.C03 | 217.2 |
| P018.S.04.A.F05 | 224.6 |
| P018.S.04.A.D06 | 354.6 |
| P018.S.12.A.C01 | 431.5 |
| P018.S.04.A.F06 | 440.1 |
| P018.S.04.A.B06 | 460.8 |
| P018.S.03.A.E03 | 528.9 |
| P018.S.04.A.A06 | 629.9 |
| P018.S.04.A.G05 | 669.5 |
| P018.S.12.A.F05 | 732.5 |
| P018.S.12.A.G05 | 745.0 |
| P018.S.11.A.C04 | 785.3 |
| P018.S.11.A.A05 | 865.3 |
| P018.S.11.A.G03 | 893.9 |
| P018.S.05.A.G03 | 966.4 |
| P018.S.05.A.G05 | 974.5 |
| P018.S.12.A.E04 | 1005.0 |
| P018.S.04.A.H05 | 1167.0 |
| P018.S.04.A.E06 | 1390.5 |
| P018.S.12.A.F03 | 1630.3 |
| P018.S.11.A.A06 | 2094.9 |
| P018.S.12.A.D05 | 2401.8 |
| P018.S.12.A.D06 | 2773.7 |
| P018.S.05.A.F05 | 7119.8 |

TABLE 6

EC50 values of agonistic anti-CD137 antibodies

| Anti-CD137 Antibody ID | EC 50 [ng/mL] |
|---|---|
| P018.S.08.A.F03 | 2710.1 |
| P018.S.13.A.C02 | 3498.0 |
| P018.S.14.A.G03 | 3499.7 |
| P018.S.13.A.A05 | 3722.8 |
| P018.S.13.A.G03 | 4776.3 |
| P018.S.08.A.E03 | 4963.8 |
| P018.S.08.A.A04 | 5152.8 |
| P018.S.14.A.H01 | 5818.0 |
| P018.S.14.A.A04 | 6789.0 |
| P018.S.13.A.A06 | 7785.1 |
| P018.S.14.A.D06 | 10208.0 |
| P018.S.13.A.G04 | 255179.8 |

TABLE 7

Sequence information of agonistic anti-CD27 antibodies (variable domains and CDRs)

| Short ID | Anti-CD27 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB27_1 | P018.S.01.A.A04 | 1/2 | 373/374/375 376/377/378 |
| AB27_2 | P018.S.01.A.A05 | 3/4 | 379/380/381 382/383/384 |
| AB27_3 | P018.S.01.A.A06 | 5/6 | 385/386/387 388/389/390 |
| AB27_4 | P018.S.01.A.B03 | 7/8 | 391/392/393 394/395/396 |
| AB27_5 | P018.S.01.A.B04 | 9/10 | 397/398/399 400/401/402 |
| AB27_6 | P018.S.01.A.B05 | 11/12 | 403/404/405 406/407/408 |
| AB27_7 | P018.S.01.A.C02 | 13/14 | 409/410/411 412/413/414 |
| AB27_8 | P018.S.01.A.C04 | 15/16 | 415/416/417 418/419/420 |
| AB27_9 | P018.S.01.A.C05 | 17/18 | 421/422/423 424/425/426 |
| AB27_10 | P018.S.01.A.C06 | 19/20 | 427/428/429 430/431/432 |
| AB27_11 | P018.S.01.A.D02 | 21/22 | 433/434/435 436/437/438 |
| AB27_12 | P018.S.01.A.D04 | 23/24 | 439/440/441 442/443/444 |
| AB27_13 | P018.S.01.A.D05 | 25/26 | 445/446/447 448/449/450 |
| AB27_14 | P018.S.01.A.E02 | 27/28 | 451/452/453 454/455/456 |
| AB27_15 | P018.S.01.A.E03 | 29/30 | 457/458/459 460/461/462 |
| AB27_16 | P018.S.01.A.E04 | 31/32 | 463/464/465 466/467/468 |
| AB27_17 | P018.S.01.A.E05 | 33/34 | 469/470/471 472/473/474 |
| AB27_18 | P018.S.01.A.E06 | 35/36 | 475/476/477 478/479/480 |
| AB27_19 | P018.S.01.A.F02 | 37/38 | 481/482/483 484/485/486 |
| AB27_20 | P018.S.01.A.F05 | 39/40 | 487/488/489 490/491/492 |
| AB27_21 | P018.S.01.A.G02 | 41/42 | 493/494/495 496/497/498 |
| AB27_22 | P018.S.01.A.G03 | 43/44 | 499/500/501 502/503/504 |
| AB27_23 | P018.S.01.A.G04 | 45/46 | 505/506/507 508/509/510 |
| AB27_24 | P018.S.01.A.G06 | 47/48 | 511/512/513 514/515/516 |
| AB27_25 | P018.S.01.A.H02 | 49/50 | 517/518/519 520/521/522 |
| AB27_26 | P018.S.01.A.H06 | 51/52 | 523/524/525 526/527/528 |
| AB27_27 | P018.S.02.A.A01 | 53/54 | 529/530/531 532/533/534 |
| AB27_28 | P018.S.02.A.A06 | 55/56 | 535/536/537 538/539/540 |
| AB27_29 | P018.S.02.A.B01 | 57/58 | 541/542/543 544/545/546 |
| AB27_30 | P018.S.02.A.B03 | 59/60 | 547/548/549 550/551/552 |
| AB27_31 | P018.S.02.A.B05 | 61/62 | 553/554/555 556/557/558 |
| AB27_32 | P018.S.02.A.C06 | 63/64 | 559/560/561 562/563/564 |
| AB27_33 | P018.S.02.A.D04 | 65/66 | 565/566/567 568/569/570 |
| AB27_34 | P018.S.02.A.E06 | 67/68 | 571/572/573 574/575/576 |
| AB27_35 | P018.S.02.A.F05 | 69/70 | 577/578/579 580/581/582 |
| AB27_36 | P018.S.02.A.F06 | 71/72 | 583/584/585 586/587/588 |
| AB27_37 | P018.S.02.A.G01 | 73/74 | 589/590/591 592/593/594 |

TABLE 7-continued

Sequence information of agonistic anti-CD27 antibodies (variable domains and CDRs)

| Short ID | Anti-CD27 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB27_38 | P018.S.02.A.G03 | 75/76 | 595/596/597 598/599/600 |
| AB27_39 | P018.S.02.A.G04 | 77/78 | 601/602/603 604/605/606 |
| AB27_40 | P018.S.02.A.H05 | 79/80 | 607/608/609 610/611/612 |
| AB27_41 | P018.S.03.A.A02 | 81/82 | 613/614/615 616/617/618 |
| AB27_42 | P018.S.03.A.B02 | 83/84 | 619/620/621 622/623/624 |
| AB27_43 | P018.S.03.A.B05 | 85/86 | 625/626/627 628/629/630 |
| AB27_44 | P018.S.03.A.C02 | 87/88 | 631/632/633 634/635/636 |
| AB27_45 | P018.S.03.A.C04 | 89/90 | 637/638/639 640/641/642 |
| AB27_46 | P018.S.03.A.C05 | 91/92 | 643/644/645 646/647/648 |
| AB27_47 | P018.S.03.A.D02 | 93/94 | 649/650/651 652/653/654 |
| AB27_48 | P018.S.03.A.D03 | 95/96 | 655/656/657 658/659/660 |
| AB27_49 | P018.S.03.A.D04 | 97/98 | 661/662/663 664/665/666 |
| AB27_50 | P018.S.03.A.D05 | 99/100 | 667/668/669 670/671/672 |
| AB27_51 | P018.S.03.A.D06 | 101/102 | 673/674/675 676/677/678 |
| AB27_52 | P018.S.03.A.E04 | 103/104 | 679/680/681 682/683/684 |
| AB27_53 | P018.S.03.A.F02 | 105/106 | 685/686/687 688/689/690 |
| AB27_54 | P018.S.03.A.F03 | 107/108 | 691/692/693 694/695/696 |
| AB27_55 | P018.S.03.A.F04 | 109/110 | 697/698/699 700/701/702 |
| AB27_56 | P018.S.03.A.G02 | 111/112 | 703/704/705 706/707/708 |
| AB27_57 | P018.S.03.A.G03 | 113/114 | 709/710/711 712/713/714 |
| AB27_58 | P018.S.03.A.G05 | 115/116 | 715/716/717 718/719/720 |
| AB27_59 | P018.S.03.A.G06 | 117/118 | 721/722/723 724/725/726 |
| AB27_60 | P018.S.03.A.H02 | 119/120 | 727/728/729 730/731/732 |
| AB27_61 | P018.S.03.A.H03 | 121/122 | 733/734/735 736/737/738 |
| AB27_62 | P018.S.03.A.H04 | 123/124 | 739/740/741 742/743/744 |
| AB27_63 | P018.S.03.A.H05 | 125/126 | 745/746/747 748/749/750 |
| AB27_64 | P018.S.04.A.A01 | 127/128 | 751/752/753 754/755/756 |
| AB27_65 | P018.S.04.A.A05 | 129/130 | 757/758/759 760/761/762 |
| AB27_66 | P018.S.04.A.B01 | 131/132 | 763/764/765 766/767/768 |
| AB27_67 | P018.S.04.A.B03 | 133/134 | 769/770/771 772/773/774 |
| AB27_68 | P018.S.04.A.B05 | 135/136 | 775/776/777 778/779/780 |
| AB27_69 | P018.S.04.A.C02 | 137/138 | 781/782/783 784/785/786 |
| AB27_70 | P018.S.04.A.C05 | 139/140 | 787/788/789 790/791/792 |
| AB27_71 | P018.S.04.A.D02 | 141/142 | 793/794/795 796/797/798 |
| AB27_72 | P018.S.04.A.D04 | 143/144 | 799/800/801 802/803/804 |
| AB27_73 | P018.S.04.A.D05 | 145/146 | 805/806/807 808/809/810 |
| AB27_74 | P018.S.04.A.E02 | 147/148 | 811/812/813 814/815/816 |

TABLE 7-continued

Sequence information of agonistic anti-CD27 antibodies (variable domains and CDRs)

| Short ID | Anti-CD27 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB27_75 | P018.S.04.A.E04 | 149/150 | 817/818/819 820/821/822 |
| AB27_76 | P018.S.04.A.E05 | 151/152 | 823/824/825 826/827/828 |
| AB27_77 | P018.S.04.A.F04 | 153/154 | 829/830/831 832/833/834 |
| AB27_78 | P018.S.04.A.G04 | 155/156 | 835/836/837 838/839/840 |
| AB27_79 | P018.S.04.A.H04 | 157/158 | 841/842/843 844/845/846 |
| AB27_80 | P018.S.05.A.A02 | 159/160 | 847/848/849 850/851/852 |
| AB27_81 | P018.S.05.A.A04 | 161/162 | 853/854/855 856/857/858 |
| AB27_82 | P018.S.05.A.A06 | 163/164 | 859/860/861 862/863/864 |
| AB27_83 | P018.S.05.A.B02 | 165/166 | 865/866/867 868/869/870 |
| AB27_84 | P018.S.05.A.B06 | 167/168 | 871/872/873 874/875/876 |
| AB27_85 | P018.S.05.A.C06 | 169/170 | 877/878/879 880/881/882 |
| AB27_86 | P018.S.05.A.D03 | 171/172 | 883/884/885 886/887/888 |
| AB27_87 | P018.S.05.A.D04 | 173/174 | 889/890/891 892/893/894 |
| AB27_88 | P018.S.05.A.D06 | 175/176 | 895/896/897 898/899/900 |
| AB27_89 | P018.S.05.A.E03 | 177/178 | 901/902/903 904/905/906 |
| AB27_90 | P018.S.05.A.E04 | 179/180 | 907/908/909 910/911/912 |
| AB27_91 | P018.S.05.A.F02 | 181/182 | 913/914/915 916/917/918 |
| AB27_92 | P018.S.05.A.F05 | 183/184 | 919/920/921 922/923/924 |
| AB27_93 | P018.S.05.A.G04 | 185/186 | 925/926/927 928/929/930 |
| AB27_94 | P018.S.05.A.H02 | 187/188 | 931/932/933 934/935/936 |
| AB27_95 | P018.S.06.A.A02 | 189/190 | 937/938/939 940/941/942 |
| AB27_96 | P018.S.06.A.A03 | 191/192 | 943/944/945 946/947/948 |
| AB27_97 | P018.S.06.A.A05 | 193/194 | 949/950/951 952/953/954 |
| AB27_98 | P018.S.06.A.B01 | 195/196 | 955/956/957 958/959/960 |
| AB27_99 | P018.S.06.A.B03 | 197/198 | 961/962/963 964/965/966 |
| AB27_100 | P018.S.06.A.C02 | 199/200 | 967/968/969 970/971/972 |
| AB27_101 | P018.S.06.A.C03 | 201/202 | 973/974/975 976/977/978 |
| AB27_102 | P018.S.06.A.C06 | 203/204 | 979/980/981 982/983/984 |
| AB27_103 | P018.S.06.A.D04 | 205/206 | 985/986/987 988/989/990 |
| AB27_104 | P018.S.06.A.E01 | 207/208 | 991/992/993 994/995/996 |
| AB27_105 | P018.S.06.A.E02 | 209/210 | 997/998/999 1000/1001/1002 |
| AB27_106 | P018.S.06.A.E04 | 211/212 | 1003/1004/1005 1006/1007/1008 |
| AB27_107 | P018.S.06.A.F01 | 213/214 | 1009/1010/1011 1012/1013/1014 |
| AB27_108 | P018.S.06.A.F03 | 215/216 | 1015/1016/1017 1018/1019/1020 |
| AB27_109 | P018.S.06.A.F04 | 217/218 | 1021/1022/1023 1024/1025/1026 |
| AB27_110 | P018.S.06.A.F06 | 219/220 | 1027/1028/1029 1030/1031/1032 |
| AB27_111 | P018.S.06.A.H04 | 221/222 | 1033/1034/1035 1036/1037/1038 |

TABLE 7-continued

Sequence information of agonistic anti-CD27 antibodies (variable domains and CDRs)

| Short ID | Anti-CD27 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB27_112 | P018.S.06.A.H05 | 223/224 | 1039/1040/1041 1042/1043/1044 |
| AB27_113 | P018.S.07.A.A02 | 225/226 | 1045/1046/1047 1048/1049/1050 |
| AB27_114 | P018.S.07.A.A05 | 227/228 | 1051/1052/1053 1054/1055/1056 |
| AB27_115 | P018.S.07.A.B03 | 229/230 | 1057/1058/1059 1060/1061/1062 |
| AB27_116 | P018.S.07.A.B04 | 231/232 | 1063/1064/1065 1066/1067/1068 |
| AB27_117 | P018.S.07.A.B05 | 233/234 | 1069/1070/1071 1072/1073/1074 |
| AB27_118 | P018.S.07.A.B06 | 235/236 | 1075/1076/1077 1078/1079/1080 |
| AB27_119 | P018.S.07.A.C02 | 237/238 | 1081/1082/1083 1084/1085/1086 |
| AB27_120 | P018.S.07.A.C04 | 239/240 | 1087/1088/1089 1090/1091/1092 |
| AB27_121 | P018.S.07.A.C06 | 241/242 | 1093/1094/1095 1096/1097/1098 |
| AB27_122 | P018.S.07.A.D03 | 243/244 | 1099/1100/1101 1102/1103/1104 |
| AB27_123 | P018.S.07.A.D04 | 245/246 | 1105/1106/1107 1108/1109/1110 |
| AB27_124 | P018.S.07.A.D05 | 247/248 | 1111/1112/1113 1114/1115/1116 |
| AB27_125 | P018.S.07.A.E03 | 249/250 | 1117/1118/1119 1120/1121/1122 |
| AB27_126 | P018.S.07.A.E05 | 251/252 | 1123/1124/1125 1126/1127/1128 |
| AB27_127 | P018.S.07.A.F03 | 253/254 | 1129/1130/1131 1132/1133/1134 |
| AB27_128 | P018.S.07.A.F04 | 255/256 | 1135/1136/1137 1138/1139/1140 |
| AB27_129 | P018.S.07.A.G02 | 257/258 | 1141/1142/1143 1144/1145/1146 |
| AB27_130 | P018.S.07.A.G04 | 259/260 | 1147/1148/1149 1150/1151/1152 |
| AB27_131 | P018.S.07.A.H02 | 261/262 | 1153/1154/1155 1156/1157/1158 |
| AB27_132 | P018.S.07.A.H04 | 263/264 | 1159/1160/1161 1162/1163/1164 |
| AB27_133 | P018.S.07.A.H05 | 265/266 | 1165/1166/1167 1168/1169/1170 |
| AB27_134 | P018.S.07.A.H06 | 267/268 | 1171/1172/1173 1174/1175/1176 |
| AB27_135 | P018.S.08.A.A01 | 269/270 | 1177/1178/1179 1180/1181/1182 |
| AB27_136 | P018.S.08.A.A03 | 271/272 | 1183/1184/1185 1186/1187/1188 |
| AB27_137 | P018.S.08.A.D01 | 273/274 | 1189/1190/1191 1192/1193/1194 |
| AB27_138 | P018.S.08.A.D02 | 275/276 | 1195/1196/1197 1198/1199/1200 |
| AB27_139 | P018.S.08.A.E02 | 277/278 | 1201/1202/1203 1204/1205/1206 |
| AB27_140 | P018.S.08.A.F01 | 279/280 | 1207/1208/1209 1210/1211/1212 |
| AB27_141 | P018.S.08.A.G02 | 281/282 | 1213/1214/1215 1216/1217/1218 |
| AB27_142 | P018.S.08.A.H02 | 283/284 | 1219/1220/1221 1222/1223/1224 |
| AB27_143 | P018.S.09.A.A02 | 285/286 | 1225/1226/1227 1228/1229/1230 |
| AB27_144 | P018.S.09.A.A03 | 287/288 | 1231/1232/1233 1234/1235/1236 |
| AB27_145 | P018.S.09.A.A05 | 289/290 | 1237/1238/1239 1240/1241/1242 |
| AB27_146 | P018.S.09.A.A06 | 291/292 | 1243/1244/1245 1246/1247/1248 |
| AB27_147 | P018.S.09.A.C02 | 293/294 | 1249/1250/1251 1252/1253/1254 |
| AB27_148 | P018.S.09.A.C03 | 295/296 | 1255/1256/1257 1258/1259/1260 |

TABLE 7-continued

Sequence information of agonistic anti-CD27 antibodies (variable domains and CDRs)

| Short ID | Anti-CD27 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB27_149 | P018.S.09.A.C06 | 297/298 | 1261/1262/1263 1264/1265/1266 |
| AB27_150 | P018.S.09.A.D02 | 299/300 | 1267/1268/1269 1270/1271/1272 |
| AB27_151 | P018.S.09.A.D04 | 301/302 | 1273/1274/1275 1276/1277/1278 |
| AB27_152 | P018.S.09.A.D05 | 303/304 | 1279/1280/1281 1282/1283/1284 |
| AB27_153 | P018.S.09.A.E02 | 305/306 | 1285/1286/1287 1288/1289/1290 |
| AB27_154 | P018.S.09.A.E03 | 307/308 | 1291/1292/1293 1294/1295/1296 |
| AB27_155 | P018.S.09.A.E05 | 309/310 | 1297/1298/1299 1300/1301/1302 |
| AB27_156 | P018.S.09.A.E06 | 311/312 | 1303/1304/1305 1306/1307/1308 |
| AB27_157 | P018.S.09.A.F05 | 313/314 | 1309/1310/1311 1312/1313/1314 |
| AB27_158 | P018.S.09.A.F06 | 315/316 | 1315/1316/1317 1318/1319/1320 |
| AB27_159 | P018.S.09.A.G06 | 317/318 | 1321/1322/1323 1324/1325/1326 |
| AB27_160 | P018.S.09.A.H03 | 319/320 | 1327/1328/1329 1330/1331/1332 |
| AB27_161 | P018.S.09.A.H04 | 321/322 | 1333/1334/1335 1336/1337/1338 |
| AB27_162 | P018.S.09.A.H06 | 323/324 | 1339/1340/1341 1342/1343/1344 |
| AB27_163 | P018.S.10.A.A03 | 325/326 | 1345/1346/1347 1348/1349/1350 |
| AB27_164 | P018.S.10.A.A04 | 327/328 | 1351/1352/1353 1354/1355/1356 |
| AB27_165 | P018.S.10.A.A06 | 329/330 | 1357/1358/1359 1360/1361/1362 |
| AB27_166 | P018.S.10.A.B01 | 331/332 | 1363/1364/1365 1366/1367/1368 |
| AB27_167 | P018.S.10.A.B02 | 333/334 | 1369/1370/1371 1372/1373/1374 |
| AB27_168 | P018.S.10.A.B03 | 335/336 | 1375/1376/1377 1378/1379/1380 |
| AB27_169 | P018.S.10.A.B06 | 337/338 | 1381/1382/1383 1384/1385/1386 |
| AB27_170 | P018.S.10.A.C01 | 339/340 | 1387/1388/1389 1390/1391/1392 |
| AB27_171 | P018.S.10.A.C02 | 341/342 | 1393/1394/1395 1396/1397/1398 |
| AB27_172 | P018.S.10.A.C03 | 343/344 | 1399/1400/1401 1402/1403/1404 |
| AB27_173 | P018.S.10.A.C05 | 345/346 | 1405/1406/1407 1408/1409/1410 |
| AB27_174 | P018.S.10.A.C06 | 347/348 | 1411/1412/1413 1414/1415/1416 |
| AB27_175 | P018.S.10.A.E01 | 349/350 | 1417/1418/1419 1420/1421/1422 |
| AB27_176 | P018.S.10.A.E02 | 351/352 | 1423/1424/1425 1426/1427/1428 |
| AB27_177 | P018.S.10.A.E04 | 353/354 | 1429/1430/1431 1432/1433/1434 |
| AB27_178 | P018.S.10.A.E06 | 355/356 | 1435/1436/1437 1438/1439/1440 |
| AB27_179 | P018.S.10.A.F01 | 357/358 | 1441/1442/1443 1444/1445/1446 |
| AB27_180 | P018.S.10.A.F04 | 359/360 | 1447/1448/1449 1450/1451/1452 |
| AB27_181 | P018.S.10.A.F05 | 361/362 | 1453/1454/1455 1456/1457/1458 |
| AB27_182 | P018.S.10.A.G03 | 363/364 | 1459/1460/1461 1462/1463/1464 |
| AB27_183 | P018.S.10.A.G05 | 365/366 | 1465/1466/1467 1468/1469/1470 |
| AB27_184 | P018.S.10.A.H01 | 367/368 | 1471/1472/1473 1474/1475/1476 |
| AB27_185 | P018.S.10.A.H02 | 369/370 | 1477/1478/1479 1480/1481/1482 |

TABLE 7-continued

Sequence information of agonistic anti-CD27 antibodies (variable domains and CDRs)

| Short ID | Anti-CD27 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB27_186 | P018.S.10.A.H05 | 371/372 | 1483/1484/1485 1486/1487/1488 |

TABLE 8

Sequence information of agonistic anti-CD134 antibodies (variable domains and CDRs)

| Short ID | Anti-CD134 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB134_1 | P018.S.02.A.F01 | 1489/1490 | 1673/1674/1675 1676/1677/1678 |
| AB134_2 | P018.S.02.A.F03 | 1491/1492 | 1679/1680/1681 1682/1683/1684 |
| AB134_3 | P018.S.02.A.H03 | 1493/1494 | 1685/1686/1687 1688/1689/1690 |
| AB134_4 | P018.S.03.A.E03 | 1495/1496 | 1691/1692/1693 1694/1695/1696 |
| AB134_5 | P018.S.04.A.A06 | 1497/1498 | 1697/1698/1699 1700/1701/1702 |
| AB134_6 | P018.S.04.A.B04 | 1499/1500 | 1703/1704/1705 1706/1707/1708 |
| AB134_7 | P018.S.04.A.B06 | 1501/1502 | 1709/1710/1711 1712/1713/1714 |
| AB134_8 | P018.S.04.A.C06 | 1503/1504 | 1715/1716/1717 1718/1719/1720 |
| AB134_9 | P018.S.04.A.D06 | 1505/1506 | 1721/1722/1723 1724/1725/1726 |
| AB134_10 | P018.S.04.A.E01 | 1507/1508 | 1727/1728/1729 1730/1731/1732 |
| AB134_11 | P018.S.04.A.E06 | 1509/1510 | 1733/1734/1735 1736/1737/1738 |
| AB134_12 | P018.S.04.A.F05 | 1511/1512 | 1739/1740/1741 1742/1743/1744 |
| AB134_13 | P018.S.04.A.F06 | 1513/1514 | 1745/1746/1747 1748/1749/1750 |
| AB134_14 | P018.S.04.A.G05 | 1515/1516 | 1751/1752/1753 1754/1755/1756 |
| AB134_15 | P018.S.04.A.H05 | 1517/1518 | 1757/1758/1759 1760/1761/1762 |
| AB134_16 | P018.S.05.A.F05 | 1519/1520 | 1763/1764/1765 1766/1767/1768 |
| AB134_17 | P018.S.05.A.G03 | 1521/1522 | 1769/1770/1771 1772/1773/1774 |
| AB134_18 | P018.S.05.A.G05 | 1523/1524 | 1775/1776/1777 1778/1779/1780 |
| AB134_19 | P018.S.08.A.B03 | 1525/1526 | 1781/1782/1783 1784/1785/1786 |
| AB134_20 | P018.S.11.A.A03 | 1527/1528 | 1787/1788/1789 1790/1791/1792 |
| AB134_21 | P018.S.11.A.A04 | 1529/1530 | 1793/1794/1795 1796/1797/1798 |
| AB134_22 | P018.S.11.A.A05 | 1531/1532 | 1799/1800/1801 1802/1803/1804 |
| AB134_23 | P018.S.11.A.A06 | 1533/1534 | 1805/1806/1807 1808/1809/1810 |
| AB134_24 | P018.S.11.A.B03 | 1535/1536 | 1811/1812/1813 1814/1815/1816 |
| AB134_25 | P018.S.11.A.B04 | 1537/1538 | 1817/1818/1819 1820/1821/1822 |
| AB134_26 | P018.S.11.A.B05 | 1539/1540 | 1823/1824/1825 1826/1827/1828 |
| AB134_27 | P018.S.11.A.B06 | 1541/1542 | 1829/1830/1831 1832/1833/1834 |
| AB134_28 | P018.S.11.A.C03 | 1543/1544 | 1835/1836/1837 1838/1839/1840 |
| AB134_29 | P018.S.11.A.C04 | 1545/1546 | 1841/1842/1843 1844/1845/1846 |
| AB134_30 | P018.S.11.A.D03 | 1547/1548 | 1847/1848/1849 1850/1851/1852 |

TABLE 8-continued

Sequence information of agonistic anti-CD134 antibodies (variable domains and CDRs)

| Short ID | Anti-CD134 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB134_31 | P018.S.11.A.D04 | 1549/1550 | 1853/1854/1855 1856/1857/1858 |
| AB134_32 | P018.S.11.A.D06 | 1551/1552 | 1859/1860/1861 1862/1863/1864 |
| AB134_33 | P018.S.11.A.E02 | 1553/1554 | 1865/1866/1867 1868/1869/1870 |
| AB134_34 | P018.S.11.A.E03 | 1555/1556 | 1871/1872/1873 1874/1875/1876 |
| AB134_35 | P018.S.11.A.E04 | 1557/1558 | 1877/1878/1879 1880/1881/1882 |
| AB134_36 | P018.S.11.A.E05 | 1559/1560 | 1883/1884/1885 1886/1887/1888 |
| AB134_37 | P018.S.11.A.E06 | 1561/1562 | 1889/1890/1891 1892/1893/1894 |
| AB134_38 | P018.S.11.A.F02 | 1563/1564 | 1895/1896/1897 1898/1899/1900 |
| AB134_39 | P018.S.11.A.F03 | 1565/1566 | 1901/1902/1903 1904/1905/1906 |
| AB134_40 | P018.S.11.A.F04 | 1567/1568 | 1907/1908/1909 1910/1911/1912 |
| AB134_41 | P018.S.11.A.F05 | 1569/1570 | 1913/1914/1915 1916/1917/1918 |
| AB134_42 | P018.S.11.A.G02 | 1571/1572 | 1919/1920/1921 1922/1923/1924 |
| AB134_43 | P018.S.11.A.G03 | 1573/1574 | 1925/1926/1927 1928/1929/1930 |
| AB134_44 | P018.S.11.A.G04 | 1575/1576 | 1931/1932/1933 1934/1935/1936 |
| AB134_45 | P018.S.11.A.G05 | 1577/1578 | 1937/1938/1939 1940/1941/1942 |
| AB134_46 | P018.S.11.A.H02 | 1579/1580 | 1943/1944/1945 1946/1947/1948 |
| AB134_47 | P018.S.11.A.H04 | 1581/1582 | 1949/1950/1951 1952/1953/1954 |
| AB134_48 | P018.S.11.A.H05 | 1583/1584 | 1955/1956/1957 1958/1959/1960 |
| AB134_49 | P018.S.11.A.H06 | 1585/1586 | 1961/1962/1963 1964/1965/1966 |
| AB134_50 | P018.S.12.A.A01 | 1587/1588 | 1967/1968/1969 1970/1971/1972 |
| AB134_51 | P018.S.12.A.A02 | 1589/1590 | 1973/1974/1975 1976/1977/1978 |
| AB134_52 | P018.S.12.A.A03 | 1591/1592 | 1979/1980/1981 1982/1983/1984 |
| AB134_53 | P018.S.12.A.A04 | 1593/1594 | 1985/1986/1987 1988/1989/1990 |
| AB134_54 | P018.S.12.A.A05 | 1595/1596 | 1991/1992/1993 1994/1995/1996 |
| AB134_55 | P018.S.12.A.A06 | 1597/1598 | 1997/1998/1999 2000/2001/2002 |
| AB134_56 | P018.S.12.A.B01 | 1599/1600 | 2003/2004/2005 2006/2007/2008 |
| AB134_57 | P018.S.12.A.B02 | 1601/1602 | 2009/2010/2011 2012/2013/2014 |
| AB134_58 | P018.S.12.A.B03 | 1603/1604 | 2015/2016/2017 2018/2019/2020 |
| AB134_59 | P018.S.12.A.B05 | 1605/1606 | 2021/2022/2023 2024/2025/2026 |
| AB134_60 | P018.S.12.A.B06 | 1607/1608 | 2027/2028/2029 2030/2031/2032 |
| AB134_61 | P018.S.12.A.C01 | 1609/1610 | 2033/2034/2035 2036/2037/2038 |
| AB134_62 | P018.S.12.A.C02 | 1611/1612 | 2039/2040/2041 2042/2043/2044 |
| AB134_63 | P018.S.12.A.C03 | 1613/1614 | 2045/2046/2047 2048/2049/2050 |
| AB134_64 | P018.S.12.A.C04 | 1615/1616 | 2051/2052/2053 2054/2055/2056 |
| AB134_65 | P018.S.12.A.C05 | 1617/1618 | 2057/2058/2059 2060/2061/2062 |
| AB134_66 | P018.S.12.A.C06 | 1619/1620 | 2063/2064/2065 2066/2067/2068 |
| AB134_67 | P018.S.12.A.D02 | 1621/1622 | 2069/2070/2071 2072/2073/2074 |

TABLE 8-continued

Sequence information of agonistic anti-CD134 antibodies (variable domains and CDRs)

| Short ID | Anti-CD134 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB134_68 | P018.S.12.A.D03 | 1623/1624 | 2075/2076/2077 2078/2079/2080 |
| AB134_69 | P018.S.12.A.D04 | 1625/1626 | 2081/2082/2083 2084/2085/2086 |
| AB134_70 | P018.S.12.A.D05 | 1627/1628 | 2087/2088/2089 2090/2091/2092 |
| AB134_71 | P018.S.12.A.D06 | 1629/1630 | 2093/2094/2095 2096/2097/2098 |
| AB134_72 | P018.S.12.A.E01 | 1631/1632 | 2099/2100/2101 2102/2103/2104 |
| AB134_73 | P018.S.12.A.E02 | 1633/1634 | 2105/2106/2107 2108/2109/2110 |
| AB134_74 | P018.S.12.A.E03 | 1635/1636 | 2111/2112/2113 2114/2115/2116 |
| AB134_75 | P018.S.12.A.E04 | 1637/1638 | 2117/2118/2119 2120/2121/2122 |
| AB134_76 | P018.S.12.A.E05 | 1639/1640 | 2123/2124/2125 2126/2127/2128 |
| AB134_77 | P018.S.12.A.E06 | 1641/1642 | 2129/2130/2131 2132/2133/2134 |
| AB134_78 | P018.S.12.A.F02 | 1643/1644 | 2135/2136/2137 2138/2139/2140 |
| AB134_79 | P018.S.12.A.F03 | 1645/1646 | 2141/2142/2143 2144/2145/2146 |
| AB134_80 | P018.S.12.A.F04 | 1647/1648 | 2147/2148/2149 2150/2151/2152 |
| AB134_81 | P018.S.12.A.F05 | 1649/1650 | 2153/2154/2155 2156/2157/2158 |
| AB134_82 | P018.S.12.A.F06 | 1651/1652 | 2159/2160/2161 2162/2163/2164 |
| AB134_83 | P018.S.12.A.G01 | 1653/1654 | 2165/2166/2167 2168/2169/2170 |
| AB134_84 | P018.S.12.A.G02 | 1655/1656 | 2171/2172/2173 2174/2175/2176 |
| AB134_85 | P018.S.12.A.G03 | 1657/1658 | 2177/2178/2179 2180/2181/2182 |
| AB134_86 | P018.S.12.A.G04 | 1659/1660 | 2183/2184/2185 2186/2187/2188 |
| AB134_87 | P018.S.12.A.G05 | 1661/1662 | 2189/2190/2191 2192/2193/2194 |
| AB134_88 | P018.S.12.A.H01 | 1663/1664 | 2195/2196/2197 2198/2199/2200 |
| AB134_89 | P018.S.12.A.H03 | 1665/1666 | 2201/2202/2203 2204/2205/2206 |
| AB134_90 | P018.S.12.A.H04 | 1667/1668 | 2207/2208/2209 2210/2211/2212 |
| AB134_91 | P018.S.12.A.H05 | 1669/1670 | 2213/2214/2215 2216/2217/2218 |
| AB134_92 | P018.S.13.A.G06 | 1671/1672 | 2219/2220/2221 2222/2223/2224 |

TABLE 9

Sequence information of agonistic anti-CD137 antibodies (variable domains and CDRs)

| Short ID | Anti-CD137 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB137_1 | P018.S.08.A.A04 | 2225/2226 | 2249/2250/2251 2252/2253/2254 |
| AB137_2 | P018.S.08.A.E03 | 2227/2228 | 2255/2256/2257 2258/2259/2260 |
| AB137_3 | P018.S.08.A.F03 | 2229/2230 | 2261/2262/2263 2264/2265/2266 |
| AB137_4 | P018.S.13.A.A05 | 2231/2232 | 2267/2268/2269 2270/2271/2272 |
| AB137_5 | P018.S.13.A.A06 | 2233/2234 | 2273/2274/2275 2276/2277/2278 |

TABLE 9-continued

Sequence information of agonistic anti-CD137 antibodies (variable domains and CDRs)

| Short ID | Anti-CD137 Antibody ID | SEQ ID NOs of Variable Domains VH/VL | SEQ ID NOs of CDRs HCDR1/HCDR2/HCDR3 LCDR1/LCDR2/LCDR3 |
|---|---|---|---|
| AB137_6 | P018.S.13.A.C02 | 2235/2236 | 2279/2280/2281 2282/2283/2284 |
| AB137_7 | P018.S.13.A.G03 | 2237/2238 | 2285/2286/2287 2288/2289/2290 |
| AB137_8 | P018.S.13.A.G04 | 2239/2240 | 2291/2292/2293 2294/2295/2296 |
| AB137_9 | P018.S.14.A.A04 | 2241/2242 | 2297/2298/2299 2300/2301/2302 |
| AB137_10 | P018.S.14.A.D06 | 2243/2244 | 2303/2304/2305 2306/2307/2308 |
| AB137_11 | P018.S.14.A.G03 | 2245/2246 | 2309/2310/2311 2312/2313/2314 |
| AB137_12 | P018.S.14.A.H01 | 2247/2248 | 2315/2316/2317 2318/2319/2320 |

Example 2: Bispecific Antibodies Targeting CD40 and CD27, CD40 and CD137 or CD40 and CD134

2.1 Reporter Assay Measuring Trans-Activation

CD40 is predominantly expressed on antigen-presenting cells (APCs), such as dendritic cells, whereas CD27, CD134 and CD137 are predominantly expressed on T cells. Thus, bispecific antibodies binding to CD40 and CD27, to CD40 and CD137 or to CD40 and CD134 are able to bind simultaneously to APCs and T cells expressing these receptors. Thereby, these bispecific antibodies are able (i) to mediate cell-to-cell interaction between APCs and T cells by receptor binding and (ii) to activate both indicated receptors at once, which is primarily induced by cross-linking and receptor clustering upon cell-to-cell interaction and not necessarily dependent on agonistic activity of the parental monospecific bivalent antibodies. Thus, these trans-activating bispecific antibodies exert costimulatory activity in the context of APC: T cell interactions.

Figure 6A:
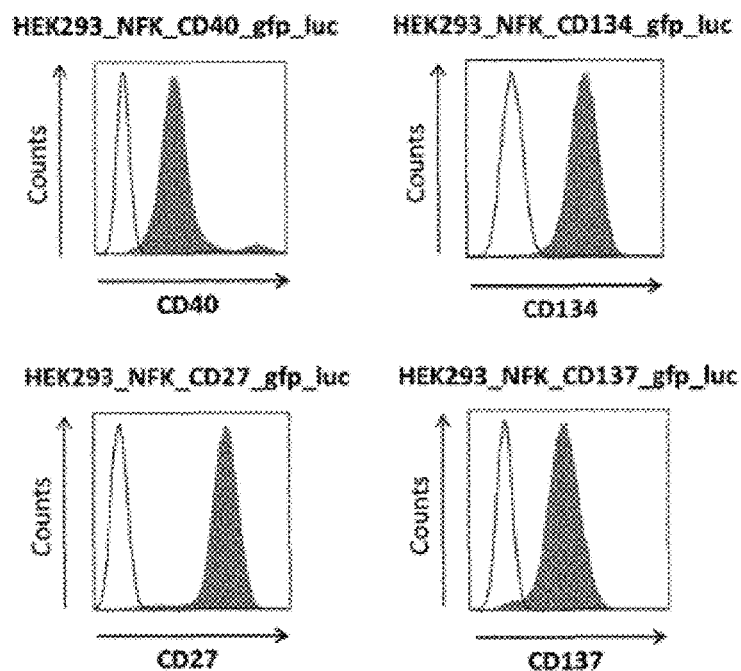
FIGS. 6A-6B show the expression of CD27, CD40, CD134 and CD137 on the cell surface of stable transfectants of HEK293_NFK_gfp_luc cells (FIG. 6A) and of stable transfectants of K562 cells (FIG. 6B) overexpressing CD27, CD40, CD134 and CD137, respectively, as determined by FACS (white curves: control without antibody; grey curves: antibody staining).
Figure 6B:
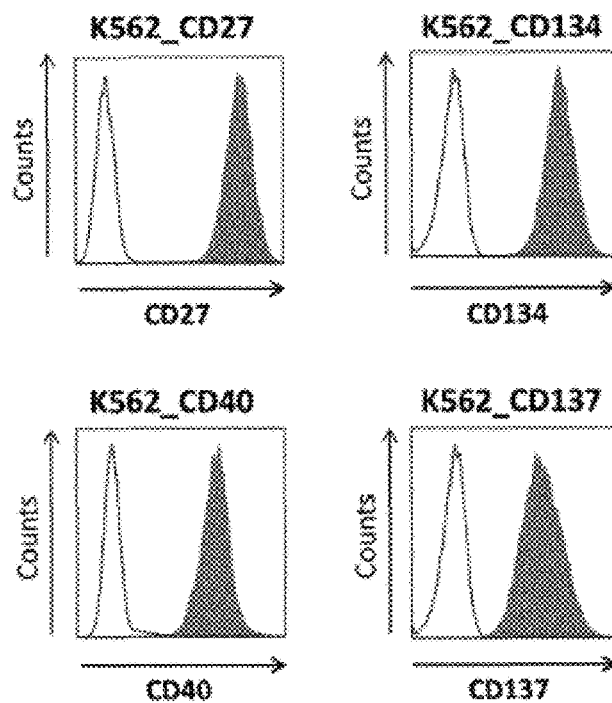
Figure 7A:
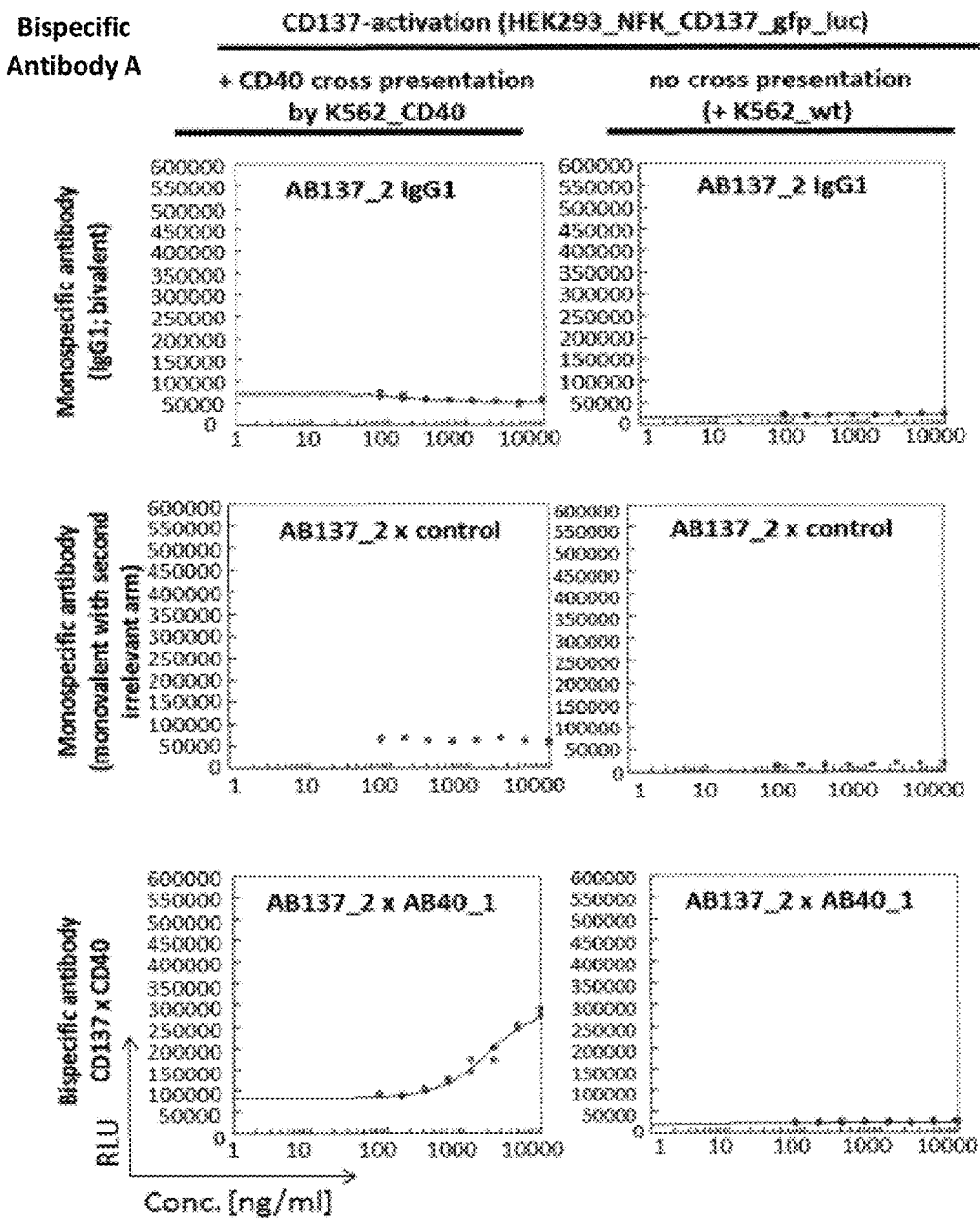
FIGS. 7A-7D show the analysis of two examples (Bispecific Antibody A and Bispecific Antibody B) of a bispecific antibody simultaneously targeting CD40 and CD137 (CD137×CD40). Activation of CD137 was measured by luciferase activity (relative light units, RLU) of HEK293_NFK_CD137_gfp_luc upon incubation with indicated bispecific antibodies and K562_CD40 for trans-presentation or K562_wt for control. Activation of CD40 was measured by luciferase activity (RLU) of HEK293_NFK_CD40_gfp_luc upon incubation with indicated bispecific antibodies and K562_CD137 for trans-presentation or K562_wt for control. The two parental monospecific, bivalent antibodies (CD137 IgG1 or CD40 IgG1) and (ii) the two monovalent antibodies with one irrelevant arm (CD137×control, CD40×control) served as controls for the bispecific CD137×CD40 antibodies. Only bispecific CD137×CD40 antibodies resulted in activation of CD137 and CD40 upon trans-presentation by CD40 and CD137, respectively. Used sequences of variable domains of anti-CD137 and anti-CD40 antibodies are identified by the abbreviation AB137 and AB40, respectively.
Figure 7B:
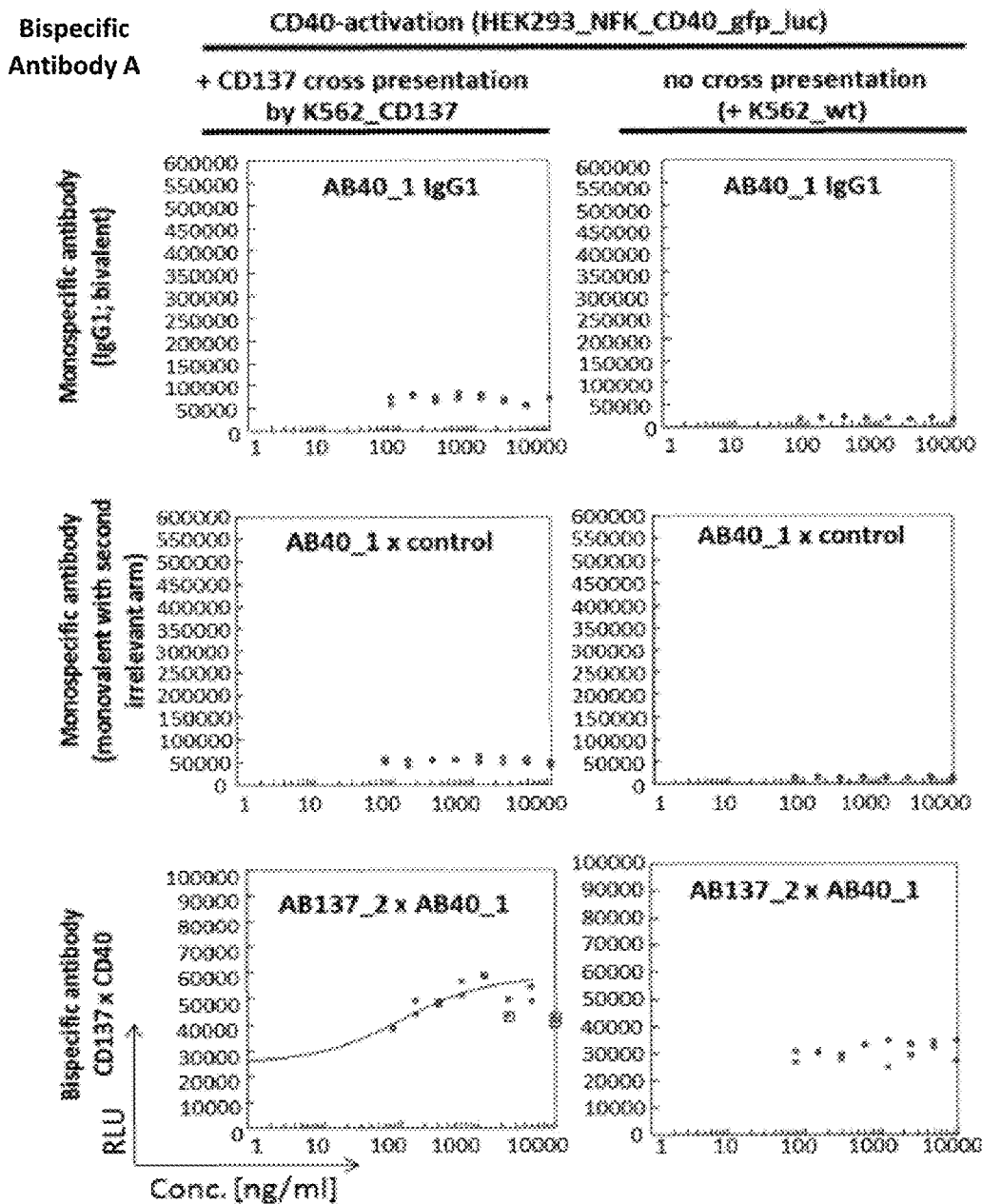
Figure 7C:
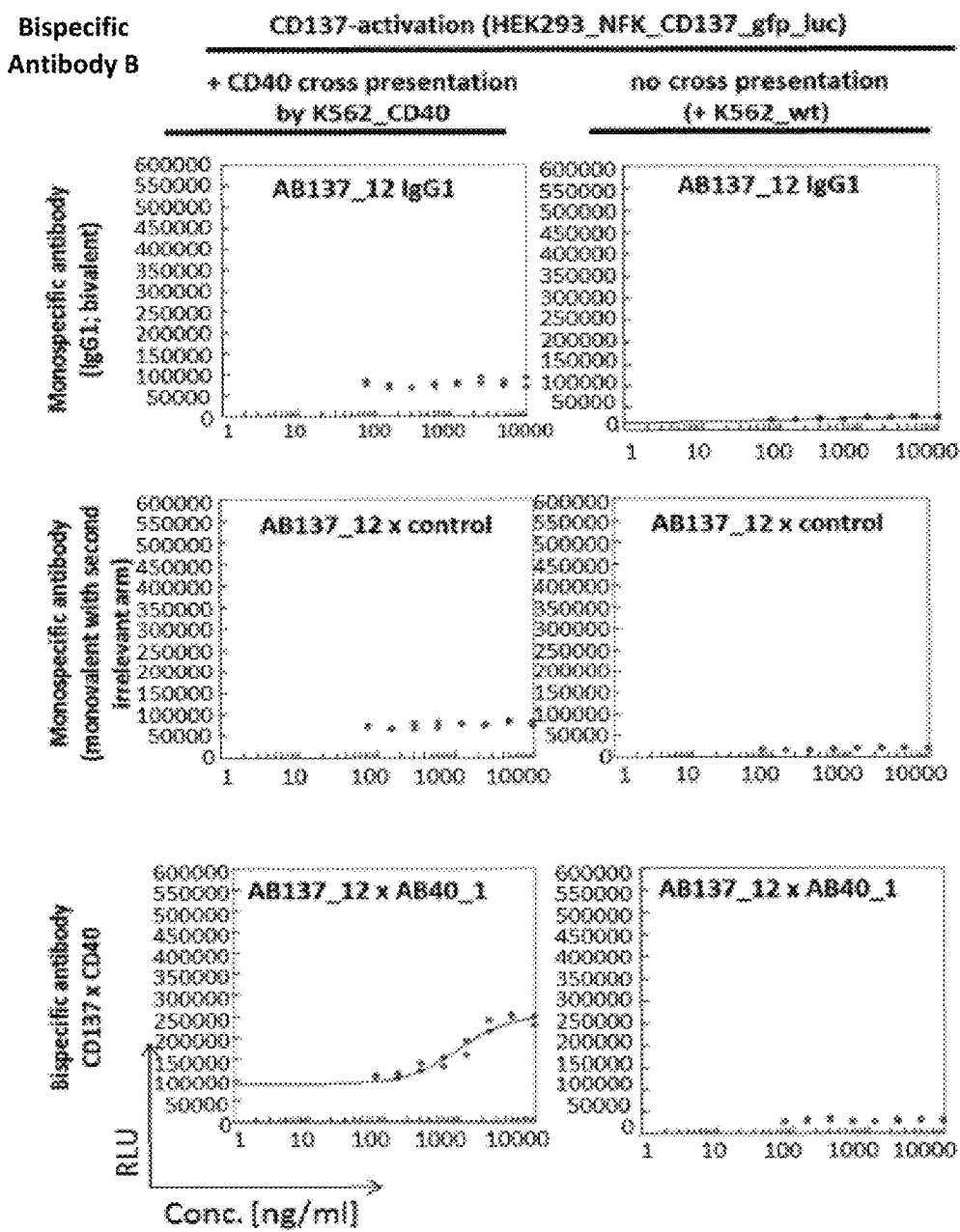
Figure 7D:
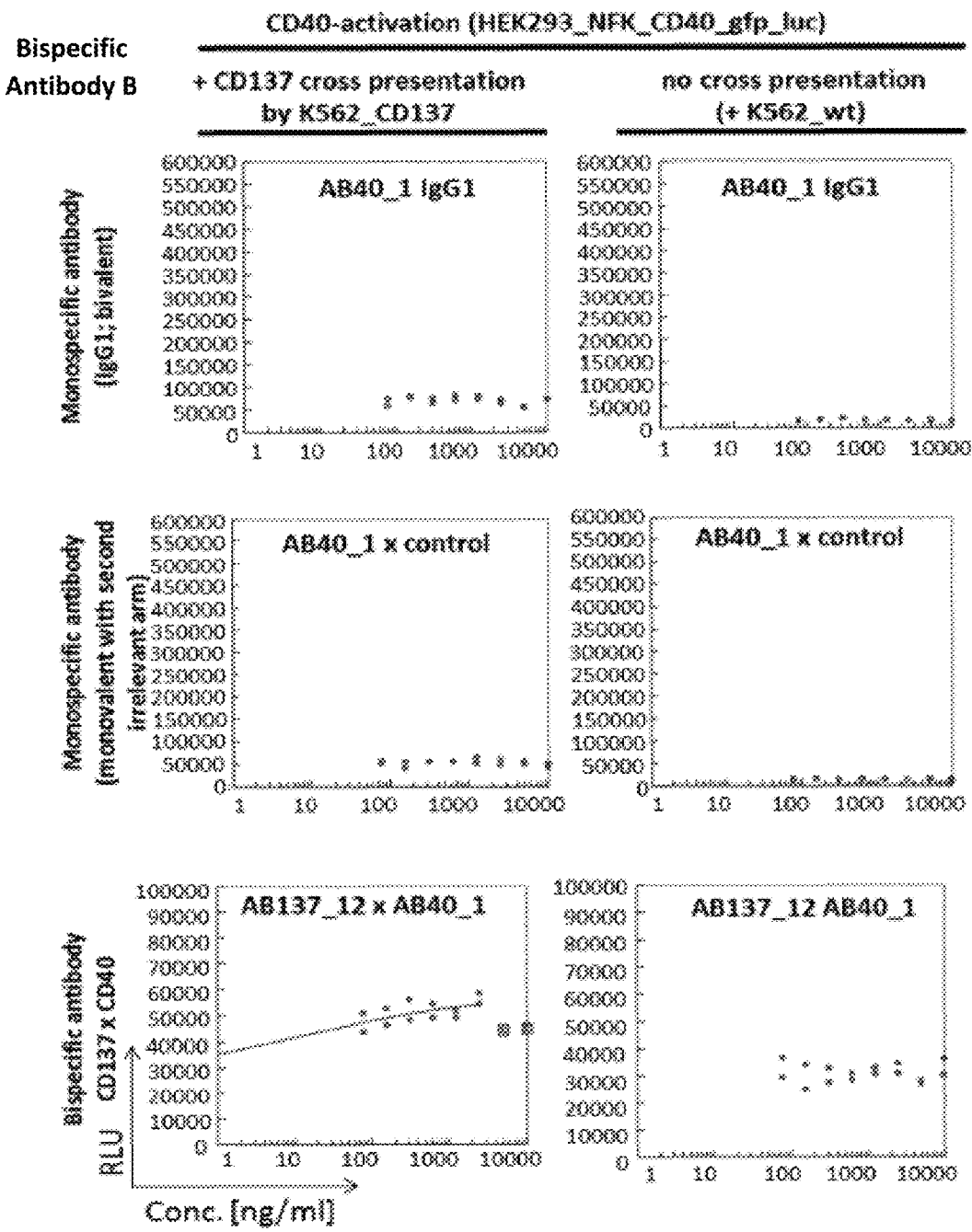

A corresponding reporter assay system was established. To that end, HEK293_NFK_gfp_luc cells were stably transduced with human TNF-receptors, CD27, CD40, CD134 and CD137, respectively. HEK293_NFK_gfp_luc (NF-κB/293/GFP-Luc™ Transcriptional Reporter Cell Line obtained from System Biosciences) is a reporter cell line which allows to monitor the NF-κB pathway by the detection of GFP fluorescence as well as luciferase activity for quantitative transcription activation reporter assays. Additionally, K562 cells were stably transduced with human TNF-receptors, CD27, CD40, CD134 and CD137, as well, in order to generate cell lines mediating trans-presentation of the indicated receptors. Cell surface expression of the receptors on HEK293 NFK_gfp_luc cells and K562 cells was analyzed by flow cytometry depicted in FIG. 6A and FIG. 6B.

The reporter assay measuring trans-activation was set up as follows: HEK293_NFK_gfp_luc cells expressing one of the 4 indicated TNF-receptors were seeded in multi-well culture plates. Bispecific antibodies and corresponding monospecific control antibodies were added in concentrations from 100 ng/ml to 10.000 ng/ml. K562 cells expressing the second TNF-receptor or wildtype K562 (K562_wt) were added to indicated wells. Thus, the bispecific antibodies are able to bind to the first TNF-receptor on the HEK293 NFK_gfp_luc cell line and, at the same time, to the second TNF-receptor on the K562 cell line mediating trans-presentation. Only receptor activation of the first TNF receptor on HEK293_NFK_gfp_luc cells is measured by luciferase activity induced upon NF-κB-signaling. Thus, bispecific antibodies targeting CD40 and CD27, CD40 and CD137 or CD40 and CD134 were analyzed by two reporter assays: (i) the first assay measuring CD27-, CD134- or CD137-activation upon cross-presentation by K562_CD40 and (ii) the second assay measuring CD40-activation upon cross-presentation by K562_CD27, K562_CD134 or K562_CD137, respectively.

2.2 Analysis of CD40×CD137 Bispecific Antibodies

Bispecific antibodies binding with one arm to CD40 and with the second arm to CD137 were produced and analyzed by the two Trans-reporter assays using HEK293_NFK_CD40_gfp_luc+K562_CD137 and HEK293_NFK_CD137_gfp_luc+K562_CD40. Two different bispecific antibodies as well as the control antibodies, the parental monospecific bivalent anti-CD40 and anti-CD137 antibodies and corresponding monovalent antibodies with one irrelevant arm, were tested (FIGS. 7A-7D). All antibodies were tested under the indicated trans-presentation conditions using K562 cells expressing the second TNF-receptor and for control without trans-presentation using K562_wt. None of the control antibodies, neither the parental monospecific bivalent antibodies nor the monovalent antibodies with one irrelevant arm, induced luciferase activity in HEK293_NFK_CD40_gfp_luc cells or in HEK293_NFK_CD137_gfp_luc cells. Only the two bispecific CD40×CD137 antibodies resulted in luciferase activity upon addition of antibodies (100 ng/ml and higher concentrations) to HEK293 NFK_CD40_gfp_luc or HEK293_NFK_CD137_gfp_luc cells under trans-presentation conditions. Thus, even if the parental monospecific, bivalent anti-CD40 and anti-CD137 IgG1 antibodies do not show agonistic activity, the bispecific CD40×CD137 antibody is able to induce activation of both receptors resulting in intracellular signaling and NF-κB pathway activation.

2.3 Analysis of CD40×CD27 Bispecific Antibodies

Figure 8A:
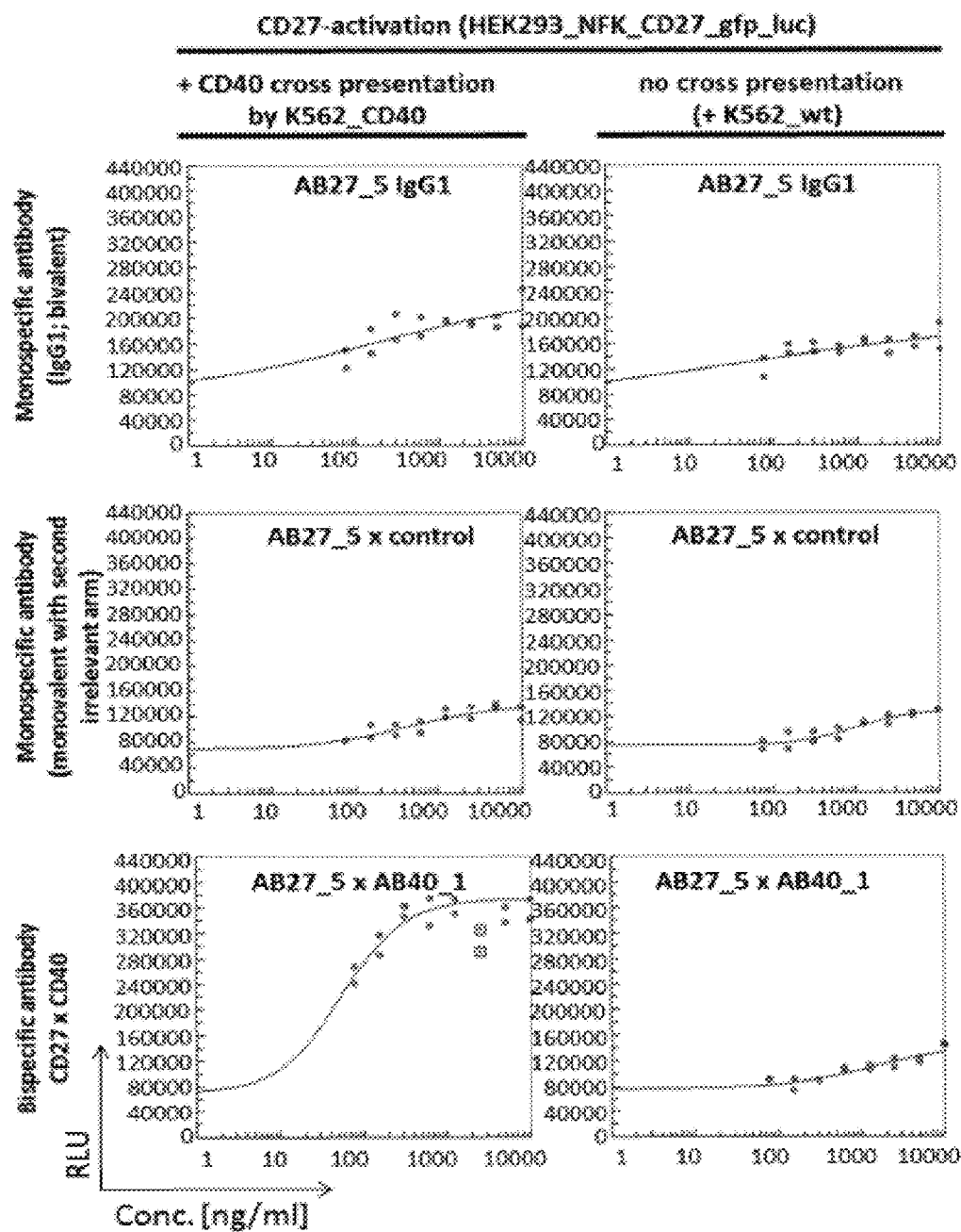
FIGS. 8A-8B show the analysis of a bispecific antibody simultaneously targeting CD40 and CD27 (CD27×CD40). Activation of CD27 was measured by luciferase activity (RLU) of HEK293_NFK_CD27_gfp_luc upon incubation with the indicated bispecific antibody and K562_CD40 for trans-presentation or K562_wt for control. Activation of CD40 was measured by luciferase activity (RLU) of HEK293_NFK_CD40_gfp_luc upon incubation with the indicated bispecific antibody and K562_CD27 for trans-presentation or K562_wt for control. The two parental monospecific, bivalent antibodies (CD27 IgG1 or CD40 IgG1) and (ii) the two monovalent antibodies with one irrelevant arm (CD27×control, CD40×control) served as controls for the bispecific CD27×CD40 antibody. The bispecific CD27×CD40 antibody resulted in superior activation of CD27 and CD40 upon trans-presentation by CD40 and CD27, respectively. Used sequences of variable domains of anti-CD27 and anti-CD40 antibodies are identified by the abbreviation AB27 and AB40, respectively.
Figure 8B:
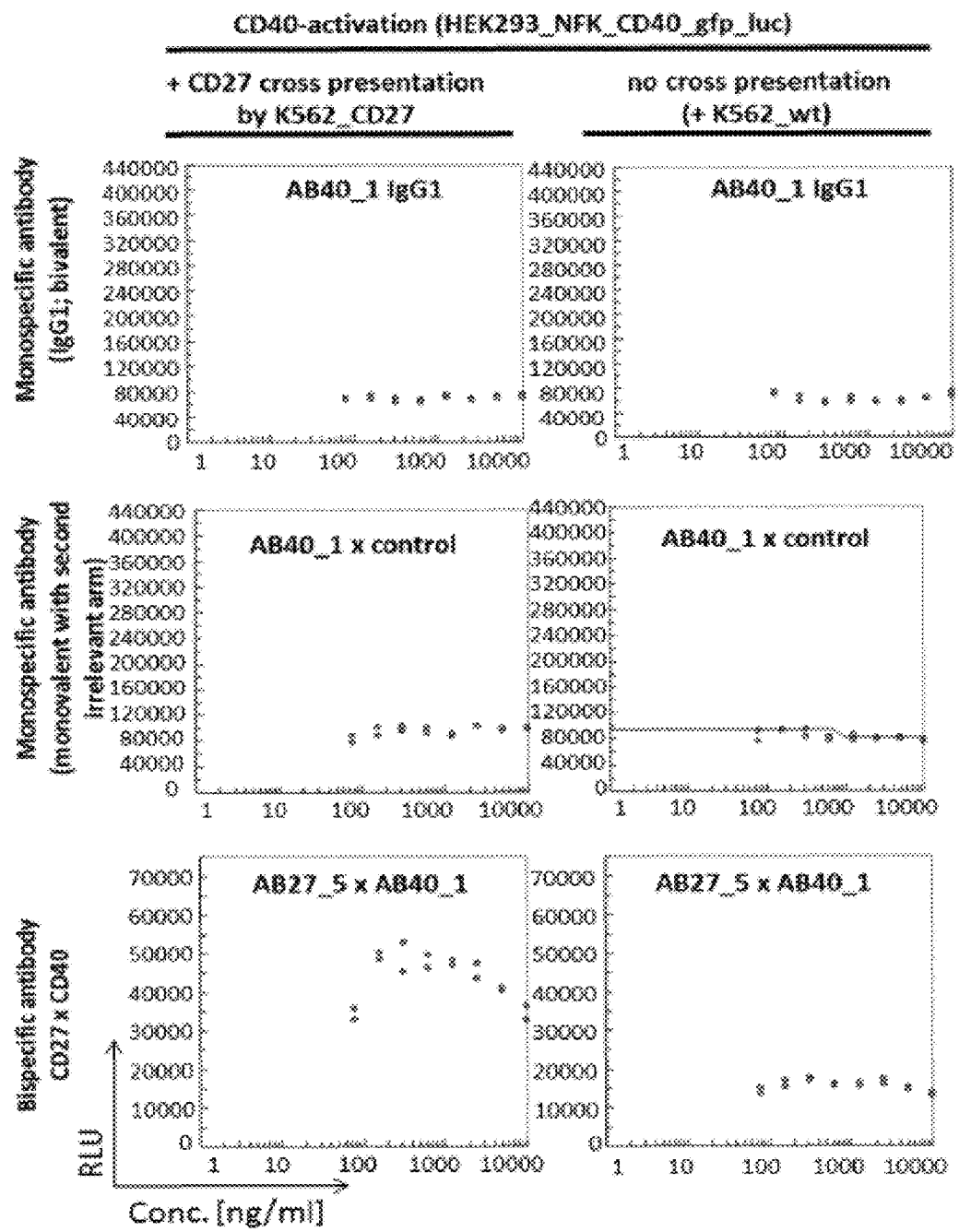
Figure 9A:
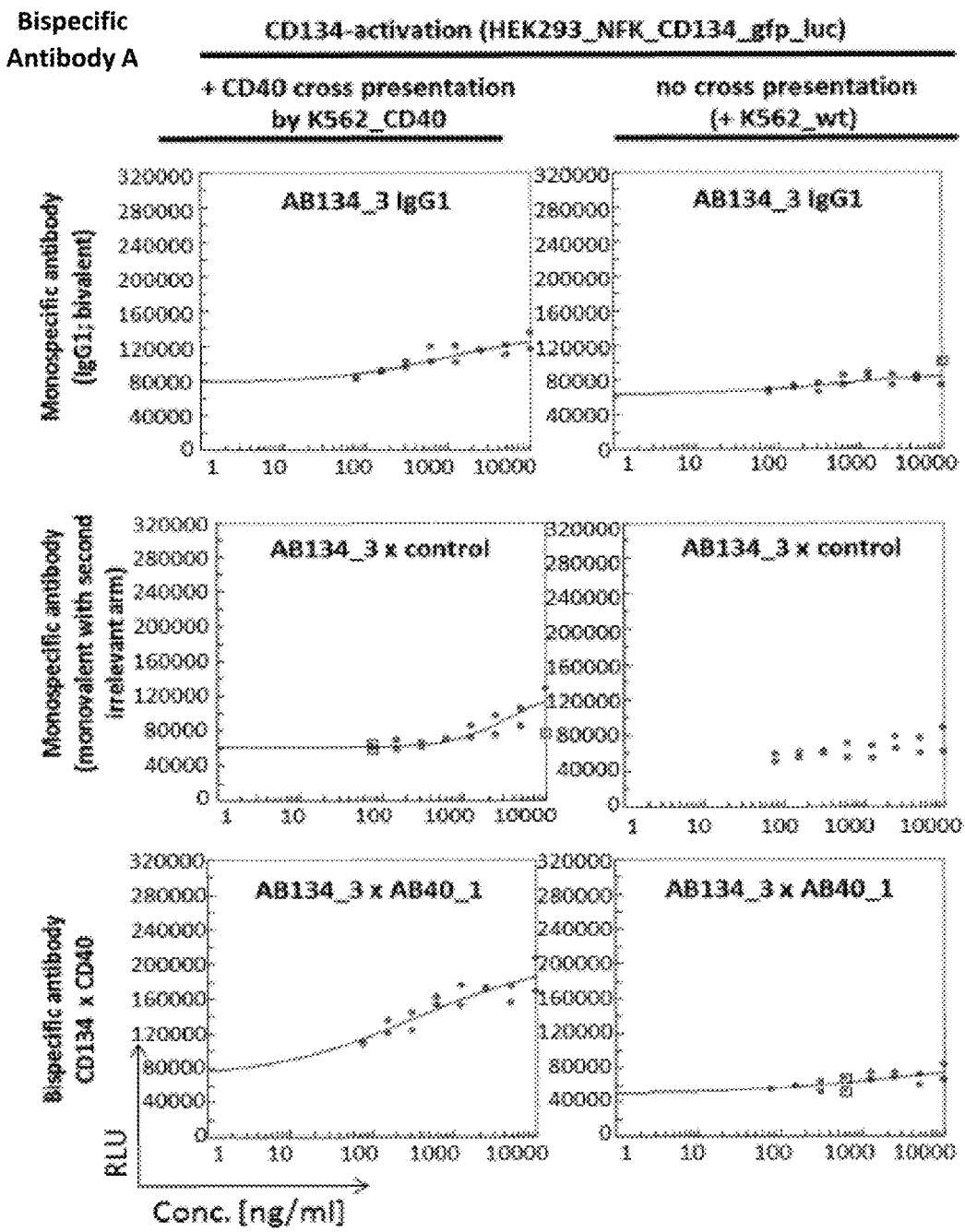
FIGS. 9A-9D show the analysis of two examples (Bispecific Antibody A and Bispecific Antibody B) of a bispecific antibody simultaneously targeting CD40 and CD134 (CD134×CD40). Activation of CD134 was measured by luciferase activity (RLU) of HEK293_NFK_CD134_gfp_luc upon incubation with the indicated bispecific antibodies and K562_CD40 for trans-presentation or K562_wt for control. Activation of CD40 was measured by luciferase activity (RLU) of HEK293_NFK_CD40_gfp_luc upon incubation with antibodies and K562 CD134 for trans-presentation or K562_wt for control. The two parental monospecific, bivalent antibodies (CD134 IgG1 or CD40 IgG1) and (ii) the two monovalent antibodies with one irrelevant arm (CD134×control, CD40×control) served as controls for the bispecific CD134×CD40 antibodies. Bispecific CD134×CD40 antibodies resulted in superior activation of CD134 and CD40 upon trans-presentation by CD40 and CD134, respectively. Used sequences of variable domains of anti-CD134 and anti-CD40 antibodies are identified by the abbreviation AB134 and AB40, respectively.
Figure 9B:
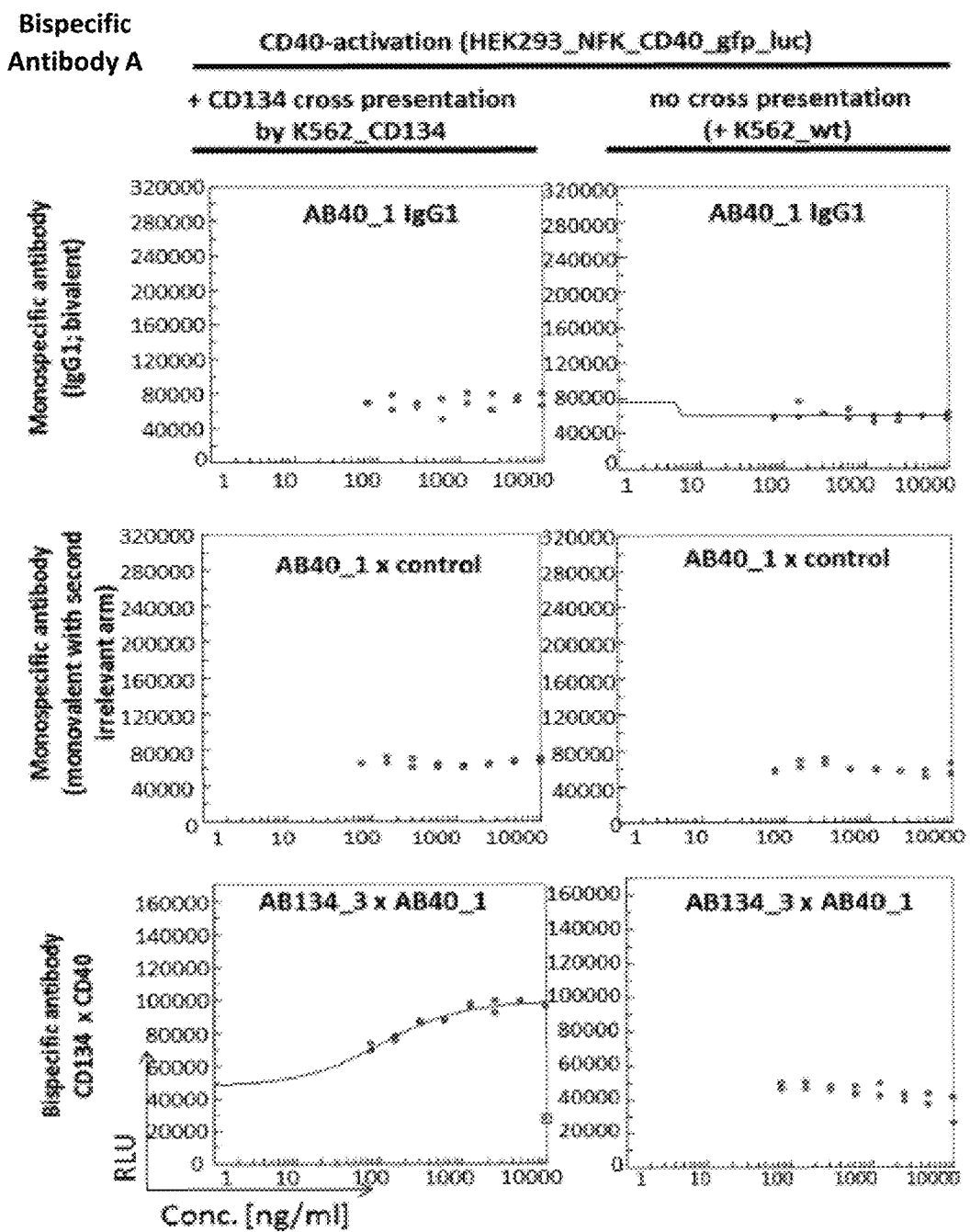
Figure 9C:
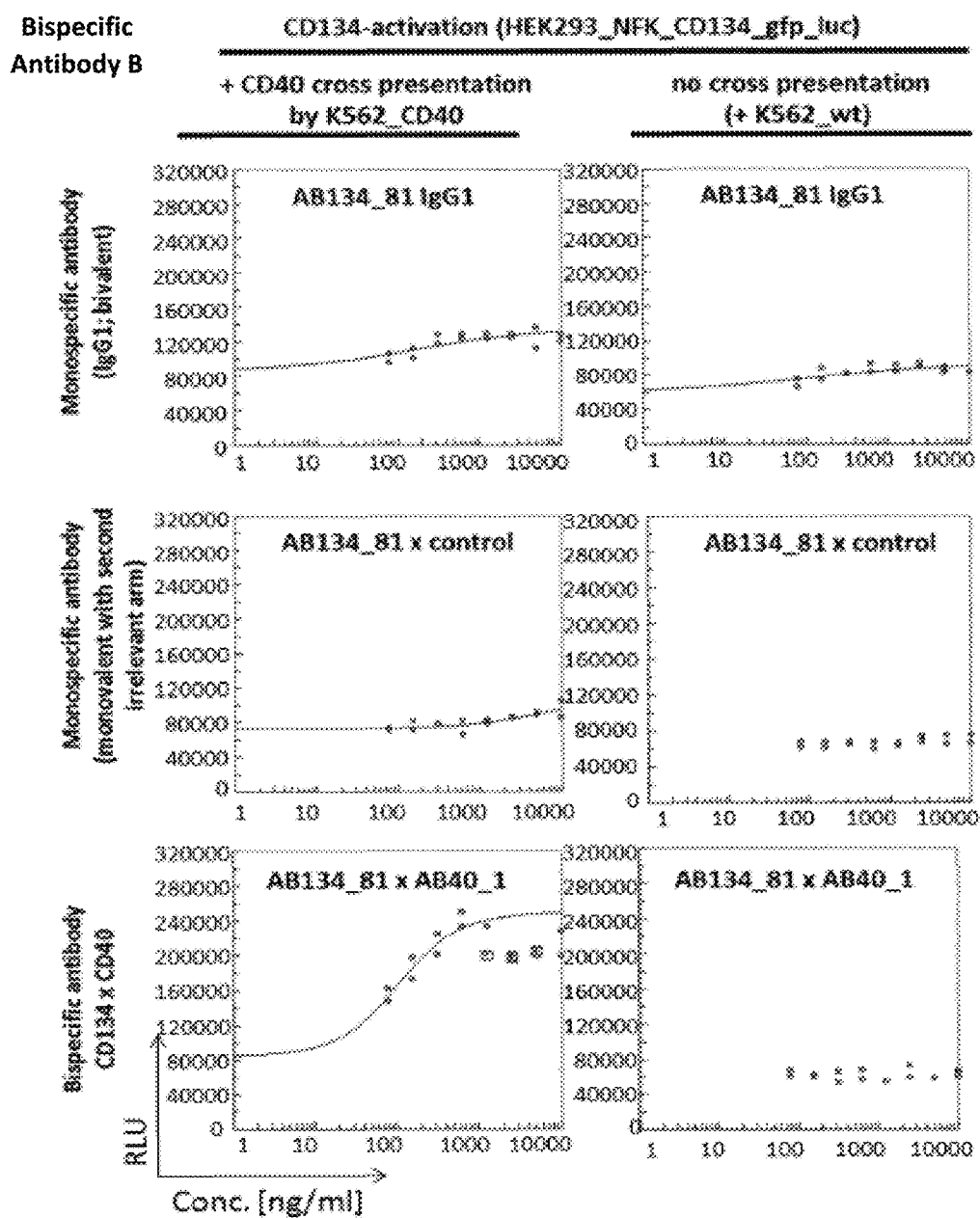
Figure 9D:
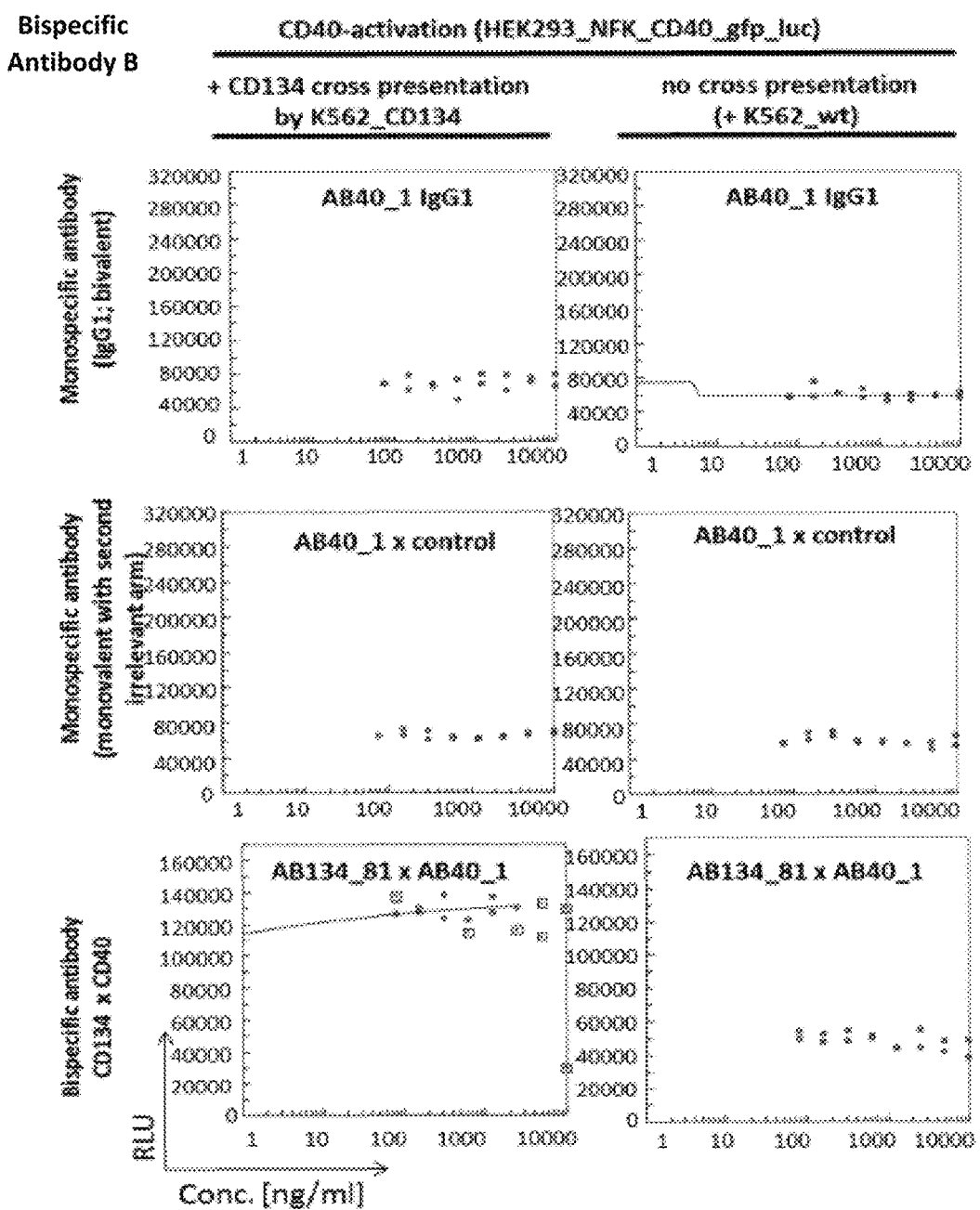

A bispecific antibody binding with one arm to CD40 and with the second arm to CD27 was produced and analyzed by the two Trans-reporter assays using HEK293_NFK_CD40_gfp_luc+K562_CD27 and HEK293_NFK_CD27_gfp_luc+K562_CD40. The bispecific antibody as well as the control antibodies, the parental monospecific bivalent anti-CD40 and anti-CD27 antibodies and corresponding monovalent antibodies with one irrelevant arm, were tested (FIGS. 8A-8B). All antibodies were tested under the indicated trans-presentation conditions using K562 cells expressing the second TNF-receptor and for control without trans-presentation using K562_wt. The bispecific antibody (100 ng/ml and higher concentrations) induced strong luciferase activity in HEK293_NFK_CD40_gfp_luc and in HEK293_NFK_CD27_gfp_luc cell lines, respectively, under trans-presentation conditions. Thus, the bispecific CD40×CD27 antibody is able to induce activation of both receptors resulting in strong intracellular signaling and NF-κB pathway activation.

2.4 Analysis of CD40×CD134 Bispecific Antibodies

Bispecific antibodies binding with one arm to CD40 and with the second arm to CD134 were produced and analyzed by the two Trans-reporter assays using HEK293_NFK_CD40_gfp_luc+K562_CD134 and HEK293_NFK_CD134_gfp_luc+K562 CD40. Two different bispecific antibodies as well as the control antibodies, the parental monospecific bivalent anti-CD40 and anti-CD134 antibodies and the corresponding monovalent antibodies with one irrelevant arm, were tested (FIGS. 9A-9D). All antibodies were tested under the indicated trans-presentation conditions using K562 cells expressing the second TNF-receptor and for control without trans-presentation using K562_wt. The parental monospecific bivalent anti-CD134 antibodies induced only very weak luciferase activity. However, the bispecific antibodies (100 ng/ml and higher concentrations) induced strong luciferase activity in HEK293_NFK_CD40_gfp_luc and in HEK293_NFK_CD134_gfp_luc cell lines, respectively, under trans-presentation conditions. Thus, even if the parental monospecific, bivalent anti-CD40 and anti-CD134 IgG1 antibodies show only slight agonistic activity the bispecific CD40×CD134 antibody is able to induce activation of both receptors resulting in strong intracellular signaling and NF-κB pathway activation.

Example 3: Bispecific Antibodies Targeting CD134 and CD27, CD134 and CD137 or CD27 and CD137

3.1 Reporter Assay Measuring Cis-Activation

CD27, CD134 and CD137 are predominantly expressed on T cells. While CD27 is constitutively expressed and CD27 expression density only varies upon T cell activation, CD134 and CD137 expression is only induced upon T cell activation. Thereby, bispecific antibodies binding to CD134 and CD27, to CD134 and CD137 or to CD27 and CD137 most probably target two receptors expressed on the same T cell. However, the activity of these bispecific antibodies depends on the co-expression of the two receptors and thereby on the activation status of the T cells. Activation of these TNF-receptors is dependent on receptor cross-linking and receptor clustering, respectively, which can be achieved by binding agents simultaneously binding to different receptors. If T cells co-express the indicated receptors, these bispecific antibodies can act as costimulatory agents mediating receptor-induced signaling in T cells upon binding of two different TNF-receptors on the same T cell.

Figure 10A:
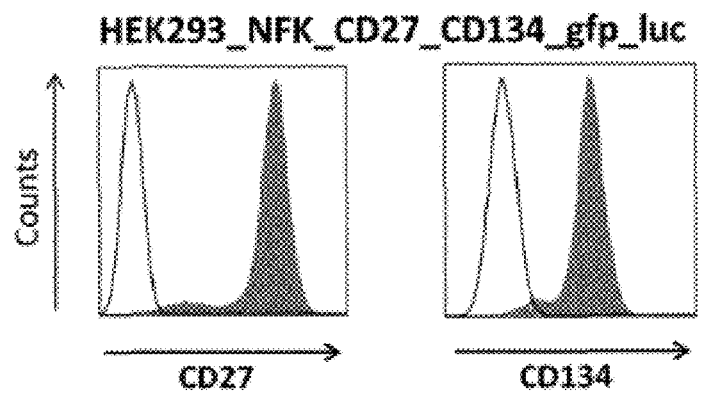
FIGS. 10A-10C show the expression of CD27, CD134 and CD137 on the cell surface of double transfectants of HEK293_NFK_gfp_luc cells overexpressing CD27+CD134 (HEK293_NFK_CD27_CD134 gfp_luc), CD134+CD137 (HEK293_NFK_CD134_CD137_gfp_luc) and CD27+CD137 (HEK293_NFK_CD27_CD137_gfp_luc), respectively, as determined by FACS (white curves: control without antibody; grey curves: antibody staining).
Figure 10B:
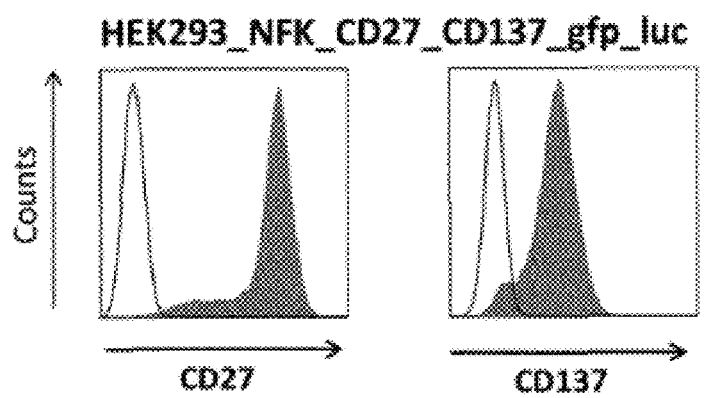
Figure 10C:
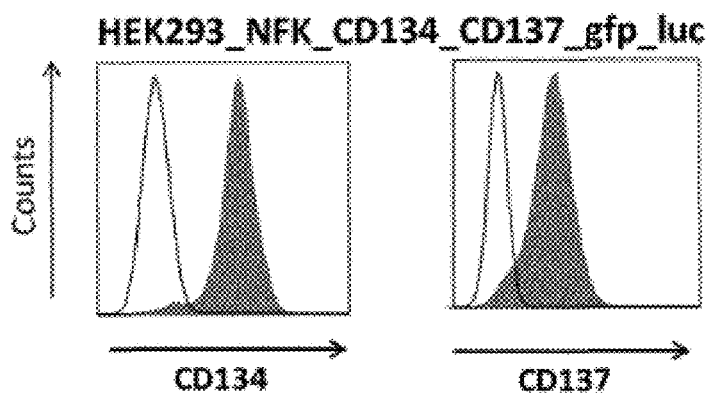

A corresponding reporter assay system was established using TNF-receptor double transfectants. To that end, HEK293_NFK_gfp_luc cells were stably transduced with two of the indicated human TNF-receptors, CD27, CD134 and CD137, respectively. Cell surface expression of the receptors was analyzed by flow cytometry depicted in FIG. 10A and FIG. 10B.

3.2 Analysis of CD134×CD27 Bispecific Antibodies

Figure 11:
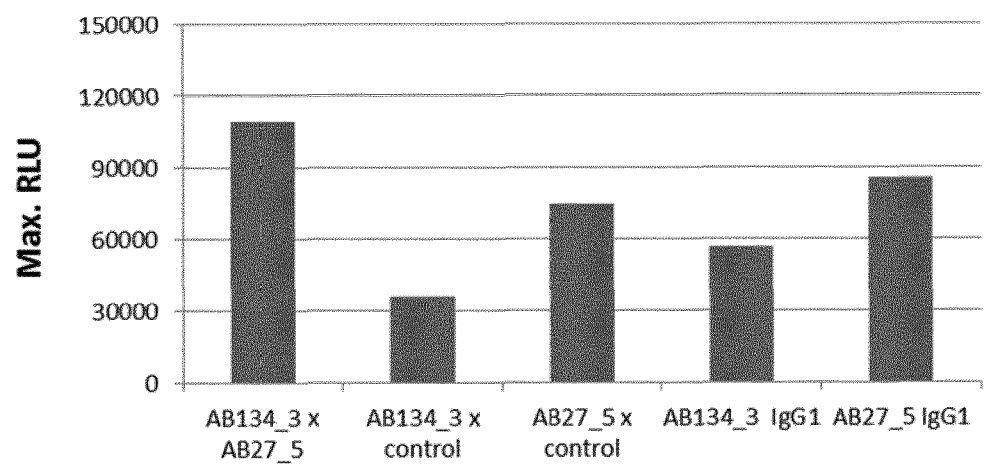
FIG. 11 shows the analysis of a bispecific antibody simultaneously targeting CD27 and CD134 (CD134×CD27). Activation of CD27 and CD134 was measured by luciferase activity of HEK293_NFK_CD27_CD134_gfp_luc upon incubation with the indicated bispecific antibody; maximum RLUs are shown. The two parental monospecific, bivalent antibodies (CD134 IgG1 or CD27 IgG1) and (ii) the two monovalent antibodies with one irrelevant arm (CD134×control, CD27×control) served as controls for the bispecific CD134×CD27 antibody. The bispecific CD134×CD27 antibody resulted in superior activation of HEK293_NFK_CD27_CD134_gfp_luc as compared to the four corresponding controls. Used sequences of variable domains of anti-CD134 and anti-CD27 antibodies are identified by the abbreviation AB134 and AB27, respectively.

A bispecific antibody binding with one arm to CD134 and with the second arm to CD27 was produced and analyzed by a Cis-reporter assay using HEK293_NFK_CD27_CD134_gfp_luc cells. The bispecific antibody as well as the control antibodies, the parental monospecific bivalent anti-CD134 and anti-CD27 antibodies and the corresponding monovalent antibodies with one irrelevant arm, were tested (FIG. 11). The bispecific antibody induced the strongest luciferase activity in HEK293_NFK_CD27_CD134_gfp_luc cells. Thus, the bispecific CD134×CD27 antibody is able to induce a strong activation of cells expressing both receptors resulting in strong NF-κB signaling.

3.3 Analysis of CD134×CD137 Bispecific Antibodies

Figure 12A:
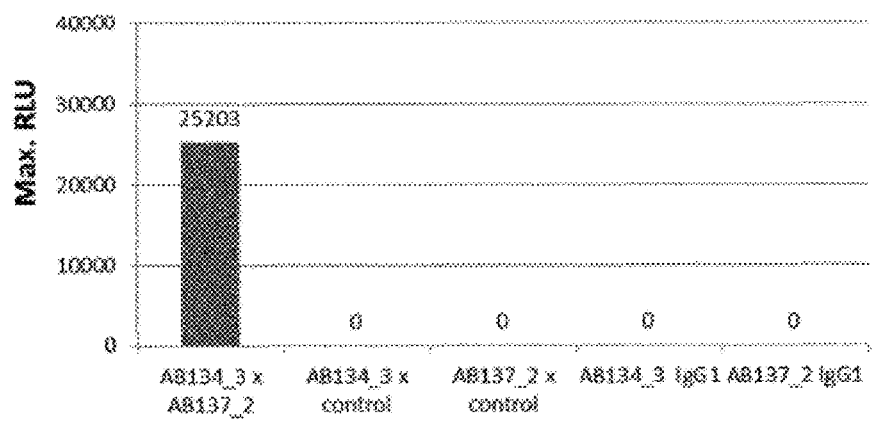
FIGS. 12A-12B show the analysis of two examples (Bispecific Antibody A and Bispecific Antibody B) of a bispecific antibody simultaneously targeting CD134 and CD137 (CD134×CD137). Activation of CD134 and CD137 was measured by luciferase activity of HEK293 NFK_CD134_CD137_gfp_luc upon incubation with the indicated bispecific antibodies; maximum RLUs are shown. The two parental monospecific, bivalent antibodies (CD134 IgG1 or CD137 IgG1) and (ii) the two monovalent antibodies with one irrelevant arm (CD134×control, CD137×control) served as controls for the bispecific CD134×CD137 antibodies. Bispecific CD134×CD137 antibodies resulted in activation of HEK293_NFK_CD134_CD137_gfp_luc, whereas the four corresponding controls did not result in measurable activation of the double transfectant. Used sequences of variable domains of anti-CD134 and anti-CD137 antibodies are identified by the abbreviation AB134 and AB137, respectively.
Figure 12B:
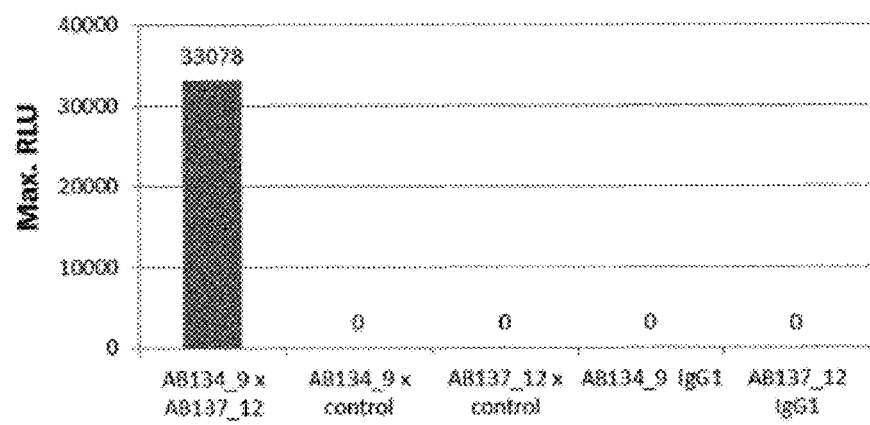

Bispecific antibodies binding with one arm to CD134 and with the second arm to CD137 were produced and analyzed by a Cis-reporter assay using the HEK291_NFK_CD134_CD137_gfp_luc cell line. Two different bispecific antibodies as well as the control antibodies, the parental monospecific bivalent anti-CD134 and anti-CD137 antibodies and corresponding monovalent antibodies with one irrelevant arm, were tested (FIGS. 12A and 12B). None of the control antibodies, neither the parental monospecific bivalent antibodies nor the monovalent antibodies with one irrelevant arm, induced luciferase activity in the HEK293_NFK_CD134_CD137_gfp_luc. Only the bispecific CD134×CD137 antibody resulted in luciferase activity. Thus, even if the parental monospecific, bivalent anti-CD134 and anti-CD137 IgG1 antibodies do not show any agonistic activity, the bispecific CD134×CD137 antibody is able to induce activation in the cell line expressing both receptors resulting in NF-κB pathway activation.

3.3 Analysis of CD27×CD137 Bispecific Antibodies

Figure 13A:
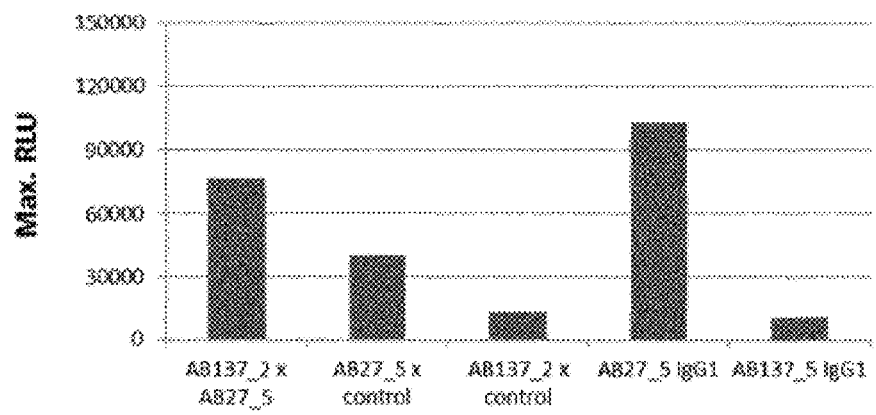
FIGS. 13A-13B show the analysis of two examples (Bispecific Antibody A and Bispecific Antibody B) of a bispecific antibody simultaneously targeting CD27 and CD137 (CD137×CD27). Activation of CD27 and CD137 was measured by luciferase activity of HEK293_NFK_CD27_CD137_gfp_luc upon incubation with the indicated bispecific antibodies; maximum RLUs are shown. The two parental monospecific, bivalent antibodies (CD137 IgG1 or CD27 IgG1) and (ii) the two monovalent antibodies with one irrelevant arm (CD137×control, CD27×control) served as controls for the bispecific CD137×CD27 antibodies. Bispecific CD134×CD27 antibodies resulted in superior activation of HEK293_NFK_CD27_CD137_gfp_luc as compared to the two control antibodies with one irrelevant arm. Used sequences of variable domains of anti-CD137 and anti-CD27 antibodies are identified by the abbreviation AB137 and AB27, respectively.
Figure 13B:
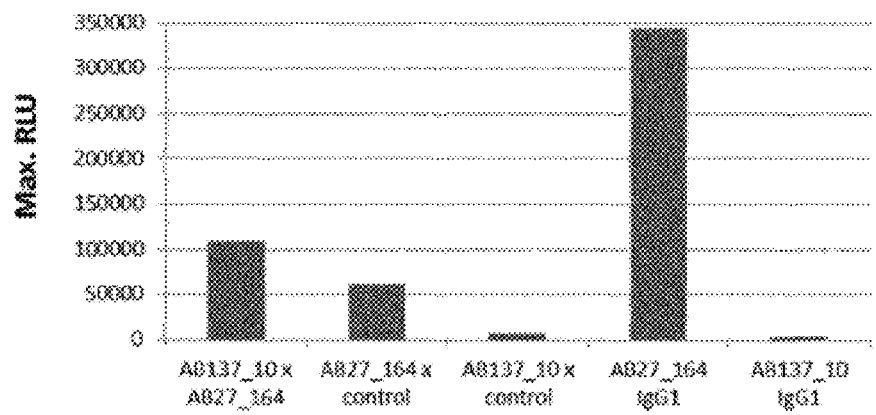

Bispecific antibodies binding with one arm to CD137 and with the second arm to CD27 were produced and analyzed by a Cis-reporter assay using HEK293 NFK_CD27_CD137_gfp_luc cells. Two different bispecific antibodies as well as the control antibodies, the parental monospecific bivalent anti-CD137 and anti-CD27 antibodies and corresponding monospecific antibodies with one irrelevant arm, were tested (FIGS. 13A and 13B). In this case, the parental monospecific bivalent anti-CD27 antibodies induced luciferase activity, whereas the parental monospecific bivalent anti-CD137 resulted only in extremely weak maximum activation signals. Both control monovalent antibodies consisting of one irrelevant arm induced very weak activation of HEK293_NFK_CD27_CD137_gfp_luc cells. However, the bispecific antibodies induced stronger luciferase activity in HEK293_NFK_CD27_CD137_gfp_luc cells than the control antibodies with one irrelevant arm.

SEQUENCE LISTING (2328 sequences)

SEQ ID NO: 1 - protein, 116 aa, Artificial Sequence
  VH
QSVEESGGRLVTPGTPLTLTCTVSGFSLSRYWVSWVRQAPGKGLEAIGVIDNGDTAYYASWAKGRFTISKTSSITVDLKMTSLTTEDTATYFCTREGADHSGQDLWGQGTLVTVSS

SEQ ID NO: 2 - protein, 112 aa, Artificial Sequence
  VL
AAVLTQTPSPVSAAVGGTVTINCQASQSVISNNDLSWYQQKPGQPPKLLIYRASNLASGVPSRFEGSGSGTQFTLTISDLESEDAATYYCQGGYAGIVDRRPFGGGTEVVVK

SEQ ID NO: 3 - protein, 123 aa, Artificial Sequence
  VH
QEQLEESGGDRVQPEGSLTLTCTASGFSFSATYWICWVRQAPGKGLEWIACIFGRSSSDTYYASWAKGRFTISKTSSTTVTLQMTSLTAADTATYFCARGDSGHPYYYSFNLWGPGTLVTVSS

SEQ ID NO: 4 - protein, 109 aa, Artificial Sequence
  VL
AYDMTQTPASVEVAVGGTVTIKCQASQSIGGYLAWYQQKPGQPPKLLIYGASTLASGVPSRFRGSGSGTEFTLTISDLDSADAATYYCQCTHGTRSDWAFGGGTEVVVK

SEQ ID NO: 5 - protein, 120 aa, Artificial Sequence
  VH
QSVEESGGRLVTPGTPLTLTCTVSGIDLSTYAMSWVRQAPGKGLEWIGIIYGSGYTYYASWAKGRATISKTSSTTVDLKITSPTTEDTATYFCASGYGISSGNFLHFNLWGQGTLVTVSS

SEQ ID NO: 6 - protein, 110 aa, Artificial Sequence
  VL
AYDMTQTPASVEVAVGGTVTIKCQASESIYFNLAWYQQKPGQRPKLLIYRASTLASGVSSRFKGSGSGTQFTLTISGVESADAATYYCQQGYDSSHIDNAFGGGTEVVVT

SEQ ID NO: 7 - protein, 113 aa, Artificial Sequence
  VH
QSLEESGGRLVTPGTPLTLTCTVSGFSLSSNAMSWVRQAPGEGLEWIGTIYTHGSSYYATWAKGRFTISKTSSTTVDLKMTSLTTEDTATYFCAGWAGGLSLWGPGTLVTVSS

SEQ ID NO: 8 - protein, 109 aa, Artificial Sequence
  VL
DVVMTQTPASVSEPVGGTVTIKCQASEDIDNALAWYQQKPGQAPKILIYSASTLPSGVPSRFKGSGSGTQFTLTISDLESADAATYYCQSAYGGTYGDGFGGGTEVVVK

SEQ ID NO: 9 - protein, 113 aa, Artificial Sequence
  VH
QEQLEESGGRLVTPGGTLTLTCTASGFSLSSYDMSWVRQAPGKGLEWIGYIWSDGNTDYASWAAGRFTASRASTTVDLKMTSLTTEDTATYFCARGYTGFFLWGPGTLVTVSS

SEQ ID NO: 10 - protein, 111 aa, Artificial Sequence
  VL
DVVMTQTPSSVSAAVGGTVTIKCQASQSIGSSYLSWYQQKPGQPPKLLIYKTSTLASGVPSRFKGSGSGTEFTLTISDLESDDAATYYCQCTYYGGSWRVAFGGGTEVVVK

SEQ ID NO: 11 - protein, 113 aa, Artificial Sequence
  VH
QEQLEESGGRLVTPGGTLTLTCTASGFSLSSYDMSWVRQAPGKGLEWIGYIWSDGNTDYATWAAGRFTASRASTTVDLKMTSLTTEDTATYFCARGYTGFFLWGPGTLVTVSS

SEQ ID NO: 12 - protein, 111 aa, Artificial Sequence
  VL
DVVMTQTPSSVSAAVGGTVTIKCQASQSIGSSYLSWYQQKPGQPPKLLIYKTSTLASGVPSRFKGSGSGTEFTLTISDLESDDAATYYCQCTYYGSSWRVAFGGGTEVVVK

SEQ ID NO: 13 - protein, 117 aa, Artificial Sequence
  VH
QSLEESGGDLVQPGASLTLTCTASGLDFISSYMCWVRQAPGKGLEWIGCIAPGGGNTYYATWAKGRFTFSETSSTTVTLQMTSLTAADTATYFCARTYPSIWYFGLWGPGTLVTVSS

SEQ ID NO: 14 - protein, 107 aa, Artificial Sequence
  VL
DVVMTQTPASVSEPVGGTVTIKCQASQSIGSNLGWYQQKPGQPPKLLIYGASTLASGVSSRFKGSGSGTEFTLTMSDLESADAATYYCQSFYAASSAFGGGTEVVVK

SEQ ID NO: 15 - protein, 115 aa, Artificial Sequence
  VH
QSLEESGGGLVTPGGTLTLTCTASGSDISTYHMGWFRQAPGKGLEYIGFINTGGTTWYASWAKGRFTVSRTSTTVDLLMTSPTTEDTATYFCARYDAGHAFFDLWGPGTLVTVSS

SEQ ID NO: 16 - protein, 112 aa, Artificial Sequence
  VL
AVVMTQTASPVSAAVGGTVTIKCQASQSIGSSYFSWYQQKPGQPPKLLIYSASTLASGVSSRFKGSGSGTEYTLTISDLESADAATYYCQGYDGDTTTAFFAFGGGTEVVVE

SEQ ID NO: 17 - protein, 119 aa, Artificial Sequence
  VH
QSLEESGGGLVQPEGSLTLTCTASGFSFSSRYYMCWVRQAPGKGLELIACIDTSSGSTWYASWAKGRFTVSKTSSTTVTLQMTSLTAADTATYFCARDLYHENSDGDWWGPGTLVTVSS

SEQ ID NO: 18 - protein, 111 aa, Artificial Sequence
  VL
AFELTQTPSSVEAAVGGTVTIKCQASESINNYLAWYQQKPGQPPKLLIYKASTLASGVSSRFKGSGSGTDFTLTISGVQSDDAATYYCQSYYGASGSGSNVFGGGTEVVVK

SEQ ID NO: 19 - protein, 117 aa, Artificial Sequence
  VH
QSVEESGGRLVTPGTPLTLTCTVSGIDLNNYVMGWVRQAPGKGLEWIGIINTAGSTYYANWAKGRFTISKTSTTVDLKITSPTTEDTATYFCARDSSYYIGYYFNLWGPGTLVTVSS

SEQ ID NO: 20 - protein, 111 aa, Artificial Sequence
  VL
QIVMTQTPASVEVAVGGTVTIKCQASQSIGSNLAWYQQKPGQPPKLLIYDASDLESGVPSRFKGSGSGAQFTLTISDLESADAATYYCQQGYSATTNVDNAFGGGTEVVVK

SEQ ID NO: 21 - protein, 117 aa, Artificial Sequence
  VH
QSLEESGGRLVTPGTPLTLTCTASGFSLSKYDMGWFRQAPGKGLEWIGMIGASDSTYYASWVKGRFTISKTSTTVDLRITSPTTEDTATYFCAREYPDARGYYYNLWGPGTPVTVSS

SEQ ID NO: 22 - protein, 110 aa, Artificial Sequence
  VL
ALVMTQTPASVEAAVGGTVTINCQASQSISDLLAWYQQKPGQPPKPLIYDASDLASGVPSRFKGSGSGTQFTLTISGVQSDDAATYYCQQGYSITNVDNVFGGGTEVVVK

SEQ ID NO: 23 - protein, 113 aa, Artificial Sequence
  VH
QEQLEESGGRLVTPGGTLTLTCTASGFSLSNYDMSWVRQAPGKGLEWIGYIWSDGNTDYASWAAGRFTASRASTTVDLKMTSLTTEDTATYFCARGYTGFFLWGPGTLVTVSS

SEQ ID NO: 24 - protein, 111 aa, Artificial Sequence
  VL
DVVMTQTPSSVSTAVGDTVTIKCQASQSIGSSYLSWYQQKPGQPPKLLIYKTSTLASGVPSRFKGSGSGTEFTLTISDLESDDAATYYCQCTYYGGSWRVAFGGGTEVVVK

SEQ ID NO: 25 - protein, 117 aa, Artificial Sequence
  VH
QSLEESGGRLVTPGTPLTLTCTASGFSLSSYYMSWVRQAPGKGLEYIGGIYTGGSAYYASWARGRFTISRTSTTVDLKMTSLTIEDTATYFCARDAGDRIYTTFNLWGPGTLVTVSS

SEQ ID NO: 26 - protein, 111 aa, Artificial Sequence
  VL
ALVMTQTPASVSEPVGGTVSLKCQASQSIGSDLSWYQQKSGQPPKLLIYRASKLASGVPSRFKGSGSGTEFTLTISGVQSDDAATYYCLGIDSYSSDDGIAFGGGTEVVVK

SEQ ID NO: 27 - protein, 117 aa, Artificial Sequence
  VH
QSVEESGGRLVTPGTPLTLTCTASGFSLSNYYMSWVRQAPGKGLEWIGIISTYGDTYYATWAKGRFTISKTSTTVDLKITSPTTEDTATYFCARGSSDTYYTYFNLWGPGTLVTVSS

SEQ ID NO: 28 - protein, 113 aa, Artificial Sequence
  VL
DIVMTQTPASVEAAVGGTVTIKCQASQKIYNNLAWYQQKPGQPPKLLIYSASTLASGVPSRFKGSGSGTEFTLTISDLESADAATYYCQSYGVSANTISYGLPFGGGTEVVVK

SEQ ID NO: 29 - protein, 115 aa, Artificial Sequence
  VH
QSVEESGGRLVTPGTPLTLTCTVSGFSLSSYAMGWVRQAPGKGLQWIGILYRNDAASYANWAKGRFTISKTSTTVDLTMPSLTTEDTATYFCVRGYVNDGYYNLWGQGTLVTVSS

SEQ ID NO: 30 - protein, 110 aa, Artificial Sequence
  VL
AYDMTQTPASVEVAVGGTVTIKCQASESIGYRLAWYQQKSGQPPKLLIFDASDLASGVPSRFKGSGSGKHFTLTISGVQSADAATYYCQQDYSYSIIDNSFGGGTEVVVK

SEQ ID NO: 31 - protein, 116 aa, Artificial Sequence
  VH
QEQLKESGGGLVTPGGTLTLTCTASGSDISNYGVSWVRQAPGKGLEWIGFINADGGGTWYASWVKGRFTISRTSTTVELKMTSLTTEHTATYFCATYGGGGGHNLWGPGTLVTVSS

SEQ ID NO: 32 - protein, 111 aa, Artificial Sequence
  VL
AQVLTQTPSSVSAAVGGTVTINCQSSQSVYDNNALAWYQQKPGQPPKLLLYSASRLASGVPSRFKGSGSGTQFTLTISDLESDDAATYYCAAYYGSGDIFAFGGGTEVVVE

SEQ ID NO: 33 - protein, 121 aa, Artificial Sequence
  VH
QEQLVESGGGLVQPEGSLTLTCTASGFSFSSRYYMCWVRQAPGKGLEWIACIAPDVSGSAYYATWAKGRITISETSSTTVTLRMTSLTAADTAIYFCARSVPGSLFYFQLWGPGTVVTVSS

SEQ ID NO: 34 - protein, 112 aa, Artificial Sequence
  VL
AAVLTQTPPSVSAAVGGTVTIKCQSSQSVYNKNEFSWYQQKPGQPPKLLIYDASTLASGVPSRFKGSGSGTQFTLTISDLESDDAATYYCQGSYYSSGSYTAFGGGTEVVVK

SEQ ID NO: 35 - protein, 118 aa, Artificial Sequence
  VH
QSLEESGGDLVKPGASLTLTCTASGIDFSSSYYMCWVRQAPGKGLEWIGCIATGGGNTYYATWAKGRFTFSETSSTTVTLQMTSLTVADTATYFCARTYPSMWYFNLWGPGTLVTVSS

SEQ ID NO: 36 - protein, 107 aa, Artificial Sequence
  VL
DVVMTQTPASVSEPVGGTVTIKCQASQSIGFNLAWYQQKPGQPPNLLIYGVSTLTSGVSSRFKGSGSGTQFTLTISDLESADAATYYCQSFYAGSSAFGGGTEVVVK

SEQ ID NO: 37 - protein, 121 aa, Artificial Sequence
  VH
QQQLVESGGGLVRPGASLTLTCKASGFSFSSGYYVCWVRQAPGKGLEWIACIFAGSGGGAGYATWAKGRFTISKTSSTTVTLQMTSLTAADTATYFCARPLSGYAYGMDLWGPGTLVTVSL

SEQ ID NO: 38 - protein, 111 aa, Artificial Sequence
  VL
DVVMTQTPASVSEPVEGTVTIKCQASQTISNYLAWYQQKPGQPPKLLIYGASTLESGVSSRFKGSGSGTQFTLTIYDLESADAATYYCQCTYDGSSDVGGAFGGGTEVVVK

SEQ ID NO: 39 - protein, 119 aa, Artificial Sequence
  VH
QEQLEESGGDLVKPEGSLTLTCTASGFSFSSSYWICWVRQAPGKGLEWIGCIITGRGNTYYANWAKGRFTISKTSSTTVTLQMTSLTAADTAIYSCARGPGGADPVNLWGPGTLVTVSS

SEQ ID NO: 40 - protein, 111 aa, Artificial Sequence
  VL
DVVMTQTPASVSEPVGGTVTIKCQASQSIYSNLAWYQQKPGQPPKLLIYRASTLTSGVPSRFKGSGSGTQFTLTISDLESADAATYYCQCTYDGSSYVPNAFGGGTEVVVK

SEQ ID NO: 41 - protein, 113 aa, Artificial Sequence; identical to SEQ ID NO: 11
  VH

SEQ ID NO: 42 - protein, 111 aa, Artificial Sequence; identical to SEQ ID NO: 10
  VL

SEQ ID NO: 43 - protein, 114 aa, Artificial Sequence
  VH
QSVEESGGRLVTPGTPLTLTCTVSGFSLSSYSMIWVRQAPGKGLEWIGIVYASGSTNYASWAKGRFTISKTSTTVDLKITSPTTEDTATYFCARGDVLYAFDPWGPGTLVTVSS

SEQ ID NO: 44 - protein, 109 aa, Artificial Sequence
  VL
AFELTQTPSSVSAAVGGTVTIKCQASENIYSYLAWYQQKPGQPPKRLIYYASNLASGVSSRFKGSGSGTEFTLTISDLESADAATYYCQYTYSTSPGYIFGGGTEVVVK

SEQ ID NO: 45 - protein, 123 aa, Artificial Sequence
  VH
QEQLVESGGGLVQPEGSLTLTCTASGVSFSNNYYISWVRQAPGKGLEWIACVYTGDDDYTYYPSWAKGRFTISKTSSTTVTLQMTSLTAADTATYFCAREILYPADTDSFDLWGPGTLVTVSS

SEQ ID NO: 46 - protein, 110 aa, Artificial Sequence
  VL
AFELTQTPSSVEAAVGGTVTIKCQASESISSRLAWYQQKPGQPPKLLIYRASTLASGVPSRFKGSGSGTDFTLTISDLESADAATYYCQAYVGISSGGYIFGGGTEVVVK

SEQ ID NO: 47 - protein, 118 aa, Artificial Sequence
  VH
QSLEESGGGLFKPTDTLTLTCTVSGIDLSRYAMGWVRQAPGKGLEYIGIISVGGGTYYANWIKGRFTISSTSTTVDLKITSPTTEDTATYFCARSPYASTSASAFNLWGPGTLVTVSS

SEQ ID NO: 48 - protein, 108 aa, Artificial Sequence
  VL
AFELTQTPSSVEAAVGGTVTIKCQASQSIYSYLSWYQQKPGQPPKLLIYEASKLASGVPSRFSGSGSGTQFTLTISDLESADAATYYCQSYSNTNTNTFGGGTEVVVK

SEQ ID NO: 49 - protein, 119 aa, Artificial Sequence
  VH
QSVEESGGRLVTPGTPLTLTCTASGFSLSSYHMQWVRQAPGKGLEWIGIIYAGSGNTWYASWAKGRFTISKTSTTVDLKITSPTTEDTAAYFCARQPGGDASDTQLDLWGQGTLVTVSS

SEQ ID NO: 50 - protein, 111 aa, Artificial Sequence
  VL
AAVLTQTASPVSAAVGGTVTINCQSSQSVFDHNQLSWFQHKPGQSPKLLIYRASTLASGVPSRFKGSGSGTQFTLTISDVQSDDAATYYCLGGYSSSSDTVFGGGTEVVVK

SEQ ID NO: 51 - protein, 113 aa, Artificial Sequence
  VH
QEQLKESGGRLVKPDETLTITCTASGFSLSRYDMSWVRQAPGKGLEWIGSIWSDGDTDYANWAKGRFTISKTSTTVDLKITSPTTEDTATYFCARGYTAWSLWGPGTLVTVSS

SEQ ID NO: 52 - protein, 112 aa, Artificial Sequence
  VL
ALVMTQTPSPVSAAVGGTVTISCQSSESVVGNNALSWFQQKPGQPPKLLNYQASTLASGVSSRFSGSGSGTQFTLTISGVQSDDAATYYCQGTYYSSGWYFAFGGGTEVVVK

SEQ ID NO: 53 - protein, 118 aa, Artificial Sequence
  VH
QSVEESGGRLVTPGTPLTLTCTVSGIDLSRYAMGWVRQAPGKGLEYIGIISSSGSTYYASWIKGRFTISKTSTTVDLKITSPTTEDTATYFCARSPYASTSASAFNLWGPGTLVTVSS

SEQ ID NO: 54 - protein, 108 aa, Artificial Sequence
  VL
AFELTQTPSSVEAAVGGTVTIKCQASQSISSWLSWYQQKPGQPPKLLIYEASKLASGVPSRFKGSGSGTQFTLTISDLESADAATYYCQSYSSTTTNTFGGGTEVVVK

SEQ ID NO: 55 - protein, 118 aa, Artificial Sequence
  VH
QSVEESGGRLVKPDESLTLTCTVSGIDLSTYAMGWVRQAPGKGLEYIGMISTGGSAYYASWAQGRFTISRTSTTVDLKMTSLTTEDTATYFCARLRDPYSYRTYFNLWGPGTLVTVSS

SEQ ID NO: 56 - protein, 109 aa, Artificial Sequence
  VL
ALVMTQTPSSVEAAVGGTVTIKCQASLSISSALAWYQQKPGQRPKLLIYDASNLESGVPSRFKGSGSGAHFTLTVSDLESADAATYYCQGPYDTVNNNSFGGGTEVVVK

SEQ ID NO: 57 - protein, 116 aa, Artificial Sequence
  VH
QSVEESGGRLVTPGTPLTLTCTVSGMDLSSYSMSWVRQAPGEGLEYIGFIGSSGGTYYASWAKGRFTISRTSTTVDLNITSPTTEDTATYFCARMLAGVYTRLDLWGQGTLVTVSS

SEQ ID NO: 58 - protein, 110 aa, Artificial Sequence
  VL
AQVLTQTPSSVSAAVGGTVTINCQASQSISSSYCSWYQQKPGQPPKLLIYKASTLASGVPSRFKGSGSGTQFTLTISDVQSDDAATYYCAGDFIASSGNAFGGGTEVVVK

SEQ ID NO: 59 - protein, 113 aa, Artificial Sequence
  VH
QSLEESGGGLVKPGGTLTLTCTASGFSLSSTYMSWVRQAPGKGLEWIGDIYTDGSTYYASWVNGRFTISKTSTTVDLKMTSLTTEDTATYFCARGAAAAYDLWGQGTLVTVSS

SEQ ID NO: 60 - protein, 110 aa, Artificial Sequence
  VL
AYDMTQTPASVSAAVGGTVTIKCQASQNIYTNLAWYQQKPGQPPKLLIYGVSNLESGVPSRFKGSGSGTQFTLTISGVQSDDAATYYCQQGYSSTNVENAFGGGTEVVVK

SEQ ID NO: 61 - protein, 121 aa, Artificial Sequence
  VH
QEQLVESGGGLVQPEGSLTLTCKASGFDFSSSYYMSWVRQAPGKGLEWIACIDTADGYTYYASWAKGRFTISKTSSTTVSLQMTSLTAADTATYFCARERIAYNTDYFNLWGPGTLVTVSS

SEQ ID NO: 62 - protein, 110 aa, Artificial Sequence
  VL
AQVLTQTPSPVSAAVGGTVTISCQSSQSLYNYNNLAWYQQKPGQPPKLLIYSVSNLASGVPSRFGGSGSGTQFTLTISDLQSDDAATYYCQGYYSGAVYTFGGGTEVVVK

SEQ ID NO: 63 - protein, 123 aa, Artificial Sequence
  VH
QEQLEESGGGLVQPEGSLTLTCKASGIDFSSNYYISWVRQAPGKGLEWIGCIYTGSDDAAYYASWAKGRFTISKTSSTTVTLQMTSLTAADTATYFCAREILYPTNTDSFDLWGPGTLVTVSS

SEQ ID NO: 64 - protein, 110 aa, Artificial Sequence
  VL
AQVLTQTPSSVSEPVGGIVTINCQASESISSRLAWYQQKPGQPPKLLIYRAATLASGVPSRFKGSGSGTDFTLTISDLESADAATYYCQSYVGASSGGYFFGGGTEVVVK

SEQ ID NO: 65 - protein, 119 aa, Artificial Sequence
  VH
QEQLVESGGGLVQPEGSLTLTCTASALSFYSAWICWVRQAPGKGLKWIACIYAGGSRSTYYATWATGRFTISEASSTTVTLQMTSLTAADTATYFCARSLSADTYWNLWGPGTLVTVSS

SEQ ID NO: 66 - protein, 109 aa, Artificial Sequence
  VL
DVVMTQTPASVEAAVGGTVTIKCQASESISSWLAWYQQKPGQPPKLLIYRASTLESGVPSRFKGSGSGTEFTLTISDLESADAATYYCQNNGGGTSGYTFGGGTEVVVK

SEQ ID NO: 67 - protein, 118 aa, Artificial Sequence
  VH
QSLEESGGRLVTPGTPLTLTCTASGFSLSNYSMNWVRQAPGKGLEWIGIINMYGSTYYATWAKGRFTISKTSTTVDLKMTSLTTEDTATYFCARDAGGSTVPWYFDLWGPGTLVTVSS

SEQ ID NO: 68 - protein, 110 aa, Artificial Sequence
  VL
AYDMTQTPASVSEPVGGTVTIKCQASESISDYLAWYQQKPGQRPKLLIYDASKLASGVPSRFSGSGSGTEFTLTISGVGSADAATYYCQQGYADSNVDNVFGGGTEVVVK

SEQ ID NO: 69 - protein, 121 aa, Artificial Sequence
  VH
QEQLVESGGDLVKPEGSLTLTCTASGFSFSSSYYMSWVRQAPGKGLEWIACIDTVDNYTYYASWAKGRFTISKTSSTTVSLQMTSLTAADTATYFCARERIAYNTDYFNLWGPGTLVTVSS

SEQ ID NO: 70 - protein, 110 aa, Artificial Sequence
  VL
AQVLTQTPSPVSAAVGGTVTISCQSSQSLYNYNNLAWYQQKPGQPPKLLIYSASNLASGVPSRFGGSGSGTQFTLTISDLQSDDAATYYCQGYYSGAVYTFGGGTEVVVK

SEQ ID NO: 71 - protein, 117 aa, Artificial Sequence
  VH
QSVEESGGRLVTPGTPLTLTCTVSGFSLSSYVMSWVRQAPGKGLEWIGYIDYGGTPYYASWAKGRFTISKTSTTVELKITSPTIEDTATYFCARGGYGGYILVTGLWGPGTLVTVSS

SEQ ID NO: 72 - protein, 110 aa, Artificial Sequence
  VL
DVVMTQTPASVSEPVGGTVTIKCQASQSISSYCSWYQQRPGQPPKLLIYGASTLASGVPSRFKGSGSGTEYTLTISDLESADAATYYCQTYYGGGPFGNGFGGGTEVVVK

SEQ ID NO: 73 - protein, 114 aa, Artificial Sequence
  VH
QSLEESGGRLVTPGTPLTLTCTVSGIDLSSNAMNWVRQAPGKGLEWIGIIYTSGSTYYASWVKGRFTISRTSTTVDLEMTSLTTEDTATYFCARGVTIDWFDLWGQGTLVTVSS

SEQ ID NO: 74 - protein, 110 aa, Artificial Sequence
  VL
AAVLTQTPSSVSAAVGGTVTINCQSSPSVYSNYLSWFQQKPGQPPKLLIYGASTLTSGVPSRFKGSGSGTQFTLTINDVQSDDAATYWCLGGYGDINDTTFGGGTEVVVK

SEQ ID NO: 75 - protein, 117 aa, Artificial Sequence
  VH
QSVEESGGRLVTPGTPLTLTCTVSGFSLSSYVMSWVRQAPGKGLEWIGYIDYGGTAYYASWAKGRFTISKTSTTVELKITSPTIEDTATYFCARGGYGGYILVTGLWGPGTLVTVSS

SEQ ID NO: 76 - protein, 110 aa, Artificial Sequence
  VL
DIVMTQTPASVSEPVGGTVTIKCQASQTIISYLSWYQQKPGQPPKLLIYGASTLASGVPSRFKGSGSVTEYTLTISDLESADAATYYCQTYYGGGPFGNGFGGGTEVVVK

SEQ ID NO: 77 - protein, 119 aa, Artificial Sequence
  VH
QSLEESGGRLVTPGGSLTLTCTVSGIDLSSYAMGWVRQAPGKGLEYIGIIYTSNRTHYATWAKGRFTISKSSTTVDLKATSLTTEDTATYFCGRYGRGSGGYYYGMDLWGPGTLVTVSS

SEQ ID NO: 78 - protein, 112 aa, Artificial Sequence
  VL
DIVMTQTPASVEAAVGGTVTIKCQASQSGDNYCSWYQQKPGQPPKLLIYQASKLTSGVPSRFRGSRSGTEYTLTISDLESADAATYYCQNYCAGSGVCLGIAFGGGTEVVVK

SEQ ID NO: 79 - protein, 122 aa, Artificial Sequence
  VH
QSLEESGGDLVKPGASLTLTCTASGIDFSSSSMCWVRQAPGKGLEWIACIDTGSSGRTDYASWAKGRFTLSKTSATTVTLQMTSLTAADTATYFCTRYGDYAGYGYDSFDPWGPGTLVTVSS

SEQ ID NO: 80 - protein, 110 aa, Artificial Sequence
  VL
AQVLTQTPSSVSAAVGGTVTINCQASQNINNWCSWYQQKPGQPPKLLIAYASTLASGVSSRFKGSGSGTQFTLTISGVQSDDAATYYCQQTFDCTDVENVFGGGTEVVVK

SEQ ID NO: 81 - protein, 114 aa, Artificial Sequence
  VH
QSVEESGGRLVTPGTPLTLTCTVSGFSLSSYDMTWVRQAPGEGLEWIGYINTDTTTYYASWAKGRFTISRTSTTVDLEITSPTTEDTATYFCARGNDPIYIDLWGQGTLVTVSS

SEQ ID NO: 82 - protein, 111 aa, Artificial Sequence
  VL
AAVLTQTPSPVSAAVGGTVSISCQSSKSVINNNWLGWYQQKPGQPPKLLISYASTLASGVPSRFSGSGSGTQFTLTISDVQSDDAATYYCAGAYSPDSENAFGGGTEVVLK

SEQ ID NO: 83 - protein, 112 aa, Artificial Sequence
  VH
QSLEESGGRLVTPGTPLTLTCTASGFSLSSYDMNWVRQAPGEGLEWIGTITTNSDTYYASWAKGRFTISKTSTTVDLKITSPTTEDTATYFCARGYTTFTLWGQGTLVTVSS

SEQ ID NO: 84 - protein, 110 aa, Artificial Sequence
  VL
DPVLTQTPSSASEPVGGTVTINCQASQNIYSNLAWYQQKPGQPPKLLIYGASTLESGVPSRFSGSGSGTQFTLTISDLESDDAATYYCQCTDYDSNYVVDFGGGTEVVVK

SEQ ID NO: 85 - protein, 122 aa, Artificial Sequence
  VH
QEQLEESGGDLVKPEGSLTLTCTASGFDLSSRYWICWVRQAPGKGLEWIGCIKTGFSNTWYASWATGRFTFSKASSTTVTLQMTSLTVADTATYFCARIAAAASASDDFRLWGPGTLVTVSS

SEQ ID NO: 86 - protein, 111 aa, Artificial Sequence
  VL
AQVLTQTPSSVSAAVGGTVTISCQSSKSVYNKWLSWFQQKPGQPPKLLIYDASDLASGVPSRFKGSGSGTEFTLTISDVQSDDAATYFCLGHYDSSSDRFVFGGGTEVVVK

SEQ ID NO: 87 - protein, 124 aa, Artificial Sequence
  VH
QSVEESGGRLVTPGTPLTLTCTVSRFSLSTSTMTWVRQAPGKGLEWIGIINGGGSAYYANWAKGRFTISKTSTTVDLKITSPTTEDTATYFCARSYDSYDDIYGTSRLYAFDPWGPGTLVTVSS

SEQ ID NO: 88 - protein, 110 aa, Artificial Sequence
  VL
AYDMTQTPASVEVVVGGTVTISCQASESIYANLAWYQQKPGQPPKLLIYRASYLASGVSSRFKGSGSGTQFTLTISGVESADAATYYCQQGYSSSNVDNSFGGGTEVVVK

SEQ ID NO: 89 - protein, 119 aa, Artificial Sequence
  VH
QSVEESGGRLVTPGTPLTLTCTVSGVDLSRYAMSWVRQAPGEGLEWIGTIWYSGTTYYASWAKGRFTISKTSSTTVDLKMTSLTAADTATYFCARDPLYVGGNSGSDLWGPGTLVTVSS

SEQ ID NO: 90 - protein, 111 aa, Artificial Sequence
  VL
DVVMTQTPASVSAAVGGTVTINCQASQSIGSSLAWYQQKPGQRPKLLIYYASTLASGVPSRFSGSGSGTEFTLTISDLESADAATYYCQSNYGAASSSYGAFGGGTEVVVK

SEQ ID NO: 91 - protein, 121 aa, Artificial Sequence
  VH
QSLEESGGGLVQPGGTLTLTCKASGIDFSSSFYMCWVRQAPGKGLERIACTYNRDGSTYYASWAKGRFTISKTSSTTVTLQMASLTVADTATYFCARDDGYPGSGYVFNLWGPGTLVTVSS

SEQ ID NO: 92 - protein, 111 aa, Artificial Sequence
  VL
DVVMTQTPASVEAAVGGTVTIKCQASQSVSSYLSWYQQKPGQRPKLLIYGASNLESGVPSRFKGSGSGTEFTLTISGVQSDDAATYYCQGGYYSSGADNNSFGGGTELVVK

SEQ ID NO: 93 - protein, 112 aa, Artificial Sequence
  VH
QSVEESGGRLVTPGTPLTLTCTVSGLSLSSYDMSWVRQAPGKGLEWIGYIWSGGTTDYASWAKGRFTISKTSTTVDLKIISPTTEDTATYFCARGYVEFDLWGPGTLVTVSS

SEQ ID NO: 94 - protein, 112 aa, Artificial Sequence
  VL
DPVLTQTPPSVSAAVGGTVTINCQSSQSLYSNNYLSWYQQKPGQPPKVLIWPASSLASGVPSRFKGSGSGTQFTLTISELQSDDAATYYCQGTFYDSGWLSTFGGGTEVVVK

SEQ ID NO: 95 - protein, 121 aa, Artificial Sequence
  VH
QEQLVESGGGLVQPEGSLTLTCTASGFSFNNNYVMSWVRQAPGKGLEWIGTIYVVSGSTYYASWVNGRFSISKTSSTTVTLQMTSLTDADTATYFCARDQLYNSGYDFDLWGPGTLVIVSS

SEQ ID NO: 96 - protein, 112 aa, Artificial Sequence
  VL
AQVLTQTASPVSAAVGSTVTISCQSSQSVYNNNELSWYQQKPGQPPKLLIYQASKLASGVSSRFSGSESGTQFTLTISGVQSDDAATYYCQGTYYRSGLDNGFGGGTEVVVK

SEQ ID NO: 97 - protein, 122 aa, Artificial Sequence
  VH
QEHLEESGGGLVQPGGTLTLTCKASGIDFSSSYYMCWVRQAPGKGLERLACTYNRDGSTYYASWAKGRFTISKTSSTTVTLQMTSLTVADTATYFCARDDGYPGSGYVLNLWGPGTLVTVSS

SEQ ID NO: 98 - protein, 111 aa, Artificial Sequence
  VL
DVVMTQTPASVEAAVGGTVTIRCQASQSVSNYFSWYQQKPGQPPKLLIYGASNLESGVPSRFKGSGSGTEFTLTISGVQSDDAATYYCQGGYYSSNTDNNSFGGGTEVVVK

SEQ ID NO: 99 - protein, 117 aa, Artificial Sequence
  VH
QSLEESGGRLVTPGTPLTLTCTASGFSLSSYYITWVRQAPGEGLEWIGTISTAGNTYFASWANGRFTISRTSTTVDLKMTSPTTEDTATYFCARDGAGDSNYYRNLWGQGTLVTVSS

SEQ ID NO: 100 - protein, 110 aa, Artificial Sequence
  VL
DIVLTQTPASVEAAVGGTVTIKCQASQSIDRFLAWYQQKPGQPPKLLIYDASDLASGVPSRFSGSGYGTEFTLTISGVQSEDAATYYCQQGYYISDIHNVFGGGTEVVVK

SEQ ID NO: 101 - protein, 118 aa, Artificial Sequence
  VH
QSLEESGGRLVTPGTPLTLTCTASGFSLSSYWMSWVRQAPGKGLEWIGYIYAGSGSAYYASWVKGRFTISKTSTTVDLKISSPTTEDTATYFCGRGNYDGYINVYDLWGPGTLVTVSS

SEQ ID NO: 102 - protein, 112 aa, Artificial Sequence
  VL
DVVMTQTPSSVEAAVGGTVTIKCQASQSIGSYLAWYQKKPGQPPKLLIYAAANLAAGVPSRFKGSGSGTDFTLTINDLESADAATYYCQNNNGAYGSAYVGAFGGGTEVVVK

SEQ ID NO: 103 - protein, 124 aa, Artificial Sequence
  VH
QEQLKESGGGLVTPGGTLTLTCTVSGIDLSSYAISWVRQAPGKGLEWIGYIYVGSTTTWYASWVKGRSTISKTSSTTVDLKMTSLTTEDTATYFCARAYDSGYIGNSFYIFHPWGPGTLVTVSS

SEQ ID NO: 104 - protein, 108 aa, Artificial Sequence
  VL
DIVMTQTPASVSATVGGTVTIKCQASQTISSRLAWYQQKPGQPPKLLIYSASTLASGVSSRFKGSGSGTEFTLTISDLESADGATYYCAGYGGLGITAFGGGTEVVVK

SEQ ID NO: 105 - protein, 117 aa, Artificial Sequence
  VH
QSVEESGGRLVTPGTPLTLTCTVSGFSLSSNAMTWVRQAPGKGLEWIGFINTGGSTYYASWAKGRFTISKTSTTVDLKITSPTTEDTATYFCARDVGDSRGYYWGLWGQGTLVTVSS

SEQ ID NO: 106 - protein, 111 aa, Artificial Sequence
  VL
AYDMTQTPASVPAAVGGTVTIKCQASEDIYSLLAWYQQKPGQPPKLLIYDASDLASGVPSRFRGSGSGTDYTLTISGVESADAATYYCQQGYTTYTTVDNIFGGGTEVVVK

SEQ ID NO: 107 - protein, 120 aa, Artificial Sequence
  VH
QSLEESGGRLVTPGGSLTLTCTVSGIDLSSYAMGWVRQAPGKGLEYLGIIYTSNRTHYATWAKGRFTISKTSSTTVDLKATSLTTEDTATYFCGRYGRGSGGYYYGMDLWGPGTLVTVSS

SEQ ID NO: 108 - protein, 112 aa, Artificial Sequence
  VL
DIVMTQTPASVEAAVGGTVTIKCQASQSGDDYCSWYQQKPGQRPKLLIYAASTLASGVPSRFRGSRSGTEYTLTISDLESADAATYYCQNYCAGSGVCLGVAFGGGTEVVVK

SEQ ID NO: 109 - protein, 115 aa, Artificial Sequence; identical to SEQ ID NO: 29
  VH

SEQ ID NO: 110 - protein, 110 aa, Artificial Sequence
  VL
AYDMTQTPASVEVAVGGTVTIKCQASESIGYRLAWYQQKPGQPPKLLIFDASDLASGVPSRFKGSGSGKHFTLTISGVQSADAATYYCQQDYSYSITDNCFGGGTEVVVS

SEQ ID NO: 111 - protein, 127 aa, Artificial Sequence
  VH
QSLEESGGDLVKPGASLTLTCTASGFSFSSGYDMCWVRQAPGKGLEWIACIYAGSNNNTYYASWAKGRFTISKTSSTTVTLQVASLTAADTATYFCARAAGGYADYAYVMGDYFNFWGPGTLVTVSS

SEQ ID NO: 112 - protein, 110 aa, Artificial Sequence
  VL
AYDMTQTPASVEVAVGGTVTIKCQASEDIYSILAWYQQKPGQRPKGLIYSASTLDSGVPLRFSGSGSGTEFTLTISGVQSDDAATYYCQQGYSSSNVDNVFGGGTEVVVK

SEQ ID NO: 113 - protein, 123 aa, Artificial Sequence
  VH
QEHLEESGGGLVQPEGSLTLTCKASGFDFSSNYYMSWVRQAPGTGLEWIACIDSGSSGSTWYASWVKGRFTISKTSSTTVTLQMTSLTDADTAAYFCVRDDVGSSYEYYFSLWGPGTLVTVSS

SEQ ID NO: 114 - protein, 108 aa, Artificial Sequence
  VL
DVVMTQTPASVSEPVGGTVTIKCQASQSIGSFLGWYQQKPGQPPKLLIYQASKLASGVPSRFKGSGSGTEYTLTISDLESADAAAYYCQTYFGSDSYVFGGGTEVVVK

SEQ ID NO: 115 - protein, 123 aa, Artificial Sequence
  VH
QSLEESGGDLVKPEGSLTLTCTASGFSFSSGGWICWVRQAPGRGLEWIACIYVGSSGTTHYASWAKGRFTISKTSSTTVTLQMTSLTAADTATYFCARGAVYGGGSYDNFHLWGPGTLVTVSS

SEQ ID NO: 116 - protein, 110 aa, Artificial Sequence
  VL
AYDMTQTPASVSEPVGGTVTIKCQASQSIGSYLSWYQQKPGQRPKLLIYAASTLASGVQSRFKGSGSGTDYTLTISGVQSDDAATYYCQQGYNISNLDNTFGGGTEVVVK

SEQ ID NO: 117 - protein, 119 aa, Artificial Sequence
  VH
QSLEESGGDLVKPGASLTLTCTASGFSFSRNNYMCWVRQAPGKGLESIACIHDGNSVGIYYTTWAKGRFTISKTSSTTVTLQMTSLTVADTATYFCARMSYTNDWDPIWGPGTLVTVSS

SEQ ID NO: 118 - protein, 112 aa, Artificial Sequence
  VL
DIVMTQTPASVEAAVGGTVTIDCQASENIYSLLAWYQQKPGQPPKVLISLASNLASGVPSRFKGSGSGTQFSLTISDLESADAATYYCQGYYYSSSTSYENAFGGGTEVVVS

SEQ ID NO: 119 - protein, 117 aa, Artificial Sequence
  VH
QSLEESGGRLMTPGGSLTLTCTVSGFSLSDYNMQWVRQAPGEGLEWIGIISLGGTTDYANWVKGRFTISKTSTTVDLKMTSLTASDTATYFCARDPAGGNWAELDLWGQGTLVTVSS

SEQ ID NO: 120 - protein, 110 aa, Artificial Sequence
  VL
DIVMTQTPASVSEPVGGTVTIKCQASQSISSWLSWFQQKPGQPPKLLIYDASTLASGVPSRFKGSGSGTEFTLTISDLESADAATYYCQQGSTISNVDNAFGGGTEVVVK

SEQ ID NO: 121 - protein, 123 aa, Artificial Sequence
  VH
QSLEESGGDLVKPEGSLTLTCTASGLDFSSSYWICWVRQAPGKGLEWIACIHAGSSGTTHYATWAKGRFTISKTSSTTVTLQMTSLTAADTATYFCARGAVYGGGSYDNFNLWGPGTLVTVSS

SEQ ID NO: 122 - protein, 110 aa, Artificial Sequence
  VL
AYDMTQTPASVEVAVGGTVTIKCQASQSIGTYLSWYQQKPGQPPKLLIYAASTLASGVQPRFKGSGSGTQFTLTISGVQSDDAATYYCQQGYSADNVANSFGGGTEVVVK

SEQ ID NO: 123 - protein, 118 aa, Artificial Sequence
  VH
QSLEESGGRLVTPGTPLTLTCTASGFSLSNYSMNWVRQAPGKGLEWIGIINTYGSAYYASWAKGRFTISKTSTTVDLKMTSLTTEDTATYFCARDAGGSTVPWFFDVWGPGTLVTVSS

SEQ ID NO: 124 - protein, 110 aa, Artificial Sequence
  VL
AYDMTQTPASVEVAVGGTVTIKCQASQTISNYLAWYQQKPGQRPKLLIYDASKLASGVPSRFDGSGSGTEYTLTISGVGSADAATYYCQQGYADSNVDNVFGGGTEVVVK

SEQ ID NO: 125 - protein, 121 aa, Artificial Sequence
  VH
QSLEESGGDLVKPGASLTLTCTASGFSFSDRHYMCWVRQAPGKGLEWIGSIYTGKDSIDYASWAKGRFTISKTSSTTVTLQMTSLTAADTATYFCARDLLYGSSSGYLHTWGPGTLVTVSS

SEQ ID NO: 126 - protein, 109 aa, Artificial Sequence
  VL
DIVMTQTPSSVSEPVGGTVTIKCQASHNIYSNLAWYQQKLGQPPKLLIYYASTLASGVPSRFKGSGSGTEYTLTISDLESDDAATYYCQSAYYGSIDITFGGGTEVVAQ

SEQ ID NO: 127 - protein, 118 aa, Artificial Sequence
  VH
QEQLVESGGGLVQPEGSLTLTCTESGFSFSSNAVCWVRQAPGKGLEWIACIYVDSIGSTWYASWAKGRFTISKTSSTTVTLQMTSLTAADTATYFCARGDNIAYFMLWGPGTLVTVSS

SEQ ID NO: 128 - protein, 113 aa, Artificial Sequence
  VL
DIVMTQTPASVEAAVGGTVTIRCQASESITSFLSWYQQKPGQPPKLLIYKISTLASGVPSRFKASGSGTEFTLTISDLESADAAAYYCQGYYYYSNVVYASNGFGGGTEVVVK

SEQ ID NO: 129 - protein, 112 aa, Artificial Sequence
  VH
QSLEESGGRLVTPGTPLTLTCTASGFTISSYEMGWVRQAPGEGLEYIGWIASGGSTFYASWAKGRFTISRTSTTVDLTITDLRPSDTGTYFCARGYVEFKLWGPGTLVTVSS

SEQ ID NO: 130 - protein, 109 aa, Artificial Sequence
  VL
DIVMTQTPASVSESVGGTVTIKCQASQSIGSYLSWYQQKPGQPPKVLIYRASTLESGVPSRFEGSGSGTQFTLTISDLESADAATYYCQGYHSTSGYVAFGGGTELVVK

SEQ ID NO: 131 - protein, 121 aa, Artificial Sequence
  VH
QEQLVESGGDLVKPGGTLTLTCTASGFSFSSSYYMSWVRQAPGKGLEWIACIDTADAYTYYASWAKGRFTISKTSSTTVSLQMTSLTAADTATYFCARERIAYNTDYFNLWGPGTLVTVSS

SEQ ID NO: 132 - protein, 110 aa, Artificial Sequence; identical to SEQ ID NO: 70
  VL

SEQ ID NO: 133 - protein, 112 aa, Artificial Sequence
  VH
QSLEESGGRLVTPGTPLTLTCTASGFSLSSYDMSWVRQAPGKGLEWIGYIWSDGDTDYANWAIGRFTISKTSTTVDLKMTSPTTEDTATYFCARGYTNYDLWGQGTLVTVSS

SEQ ID NO: 134 - protein, 112 aa, Artificial Sequence
  VL
AAVLTQTPSSVSAAVGGTVTISCQSSQSLYSDPYLSWHQQKPGQPPKRLIYQASTLASGVSSRFKGSGSGTEYTLTISDVQSDDAATYFCQGTYYSDGWYSDFGGGTEVVVK

SEQ ID NO: 135 - protein, 113 aa, Artificial Sequence
  VH
QSVEESGGRLVTPGTPLTLTCTASGFTLSSFYMSWVRQAPGKGLEWIGFIHGHGNTYYASWAKGRFTISKTSTTVDLKIASPTTEDTATYFCARGGHPNMDLWGQGTLVTISS

SEQ ID NO: 136 - protein, 110 aa, Artificial Sequence
  VL
DIVMTQTPSSVEAAVGGTVTIKCQASQNINNYLAWYQQKPGQPPKLLIYYASTLASGVSSRFKGSGSGTEFTLTISDLESDDAATYYCQCSYYDASIFGAFGGGTEVVVR

SEQ ID NO: 137 - protein, 121 aa, Artificial Sequence; identical to SEQ ID NO: 69
  VH

SEQ ID NO: 138 - protein, 110 aa, Artificial Sequence
  VL
AQVLTQTPSPVSAAVGGTVTISCQSSQSLYNYNNLAWYQQKPGQPPKLLIYSVSNLASGVPSRFGGGGSGTQFTLTISDLQSADAATYYCQGYYSGAVYTFGGGTEVVVK

SEQ ID NO: 139 - protein, 116 aa, Artificial Sequence
  VH
QSVEESGGRLVTPGTPLTLTCTVSGFSLNYYSMAWVRQVPGEGLEWIGTINTGGGTYYASWAKGRFTISKTSTTVDLKMTSLTAADTATYFCARSDGTGITYYNLWGQGALVTVSS

SEQ ID NO: 140 - protein, 108 aa, Artificial Sequence
  VL
ALVMTQTASPVSAAVGGTVTINCQASETIYSNLAWYQQKQGQPPKLLIYRASNLASGVPSRFSGSESGTQFTLTISGVQSDDAATYYCQGYYNTGITGFGGGTEVVVK

SEQ ID NO: 141 - protein, 115 aa, Artificial Sequence
  VH
QSLEESGGRLVTPGTPLTLTCTASGFSLSTYAMGWVRQAPGEGLEWIGNINTDSGDTWYARWAKGRFTISTTSSTTVDLKITSPTIEDTATYFCARNPGDDVNLWGQGTLVTVSS

SEQ ID NO: 142 - protein, 110 aa, Artificial Sequence
  VL
AQVLTQTPSPVSAAVGDTVTINCQASQSVYNNNDLAWFQQKPGQPPKLLIYRTSILASGVPSRFKGSGSGTQFTLTISDLESDDAATYYCQGYYSGVIYVFGGGTEVVVK

SEQ ID NO: 143 - protein, 117 aa, Artificial Sequence
  VH
QSVEESGGRLVTPGTPLTLTCTVSGIDLSSYSMTWVRQAPGKGLEWIGFINTGGRGYYASWAKGRFTISKTSTTVDLKITSPTTEDTATYFCARDAGSSRGYYRDLWGQGTLVTVSS

SEQ ID NO: 144 - protein, 111 aa, Artificial Sequence
  VL
AYDMTQTPASVSAAVGGTVTIKCQASEDIYSLLAWYQQKPGQPPKLLIYDASDLASGVPSRFSGSGSGTDYTLTISGVESADAATYYCQQGYTTSTTVDNIFGGGTEVVVK

SEQ ID NO: 145 - protein, 114 aa, Artificial Sequence
  VH
QSLEESGGRLVTPGTPLTLTCTASGIDLSRHAINWVRQAPGKGLEYIGTIYASGSTFYASGAKGRFTISKTSTTVDLGITSLTTEDTATYFCARGITIEWFDLWGQGTLVTVSS

SEQ ID NO: 146 - protein, 110 aa, Artificial Sequence
  VL
AAVLTQTPSSVSAAVGGTVTINCQSSPSVYSNYLSWFQQKPGQPPKLLIYGAATLASGVPSRFRGSGSGTEFTLTITDVQSDDAATYYCLGGYSDTADTIFGGGTEVVVK

SEQ ID NO: 147 - protein, 112 aa, Artificial Sequence
  VH
QSVEESGGRLVTPGTPLTLTCTVSGFSLNNYDMNWVRQAPGKGLEWVGYIDTGGSAYYASWVNGRFTISKTSTTVELKMTSLTASDTATYFCARGYTHGYLWGQGTLVTVSS

SEQ ID NO: 148 - protein, 111 aa, Artificial Sequence
  VL
ALVMTQTPSSVSAAVGGTVTINCQASQNVYNNLAWYQQKPGQPPKLLIDSASTLASGVSSRFKGSGSGTEFTLTISDLESADAATYYCQSADWESSNFFWAFGGGTEVVVK

SEQ ID NO: 149 - protein, 118 aa, Artificial Sequence
  VH
QSVEESGGRLVTPGTPLTLTCTVSGFSLSTYAMNWIRQAPGKGLEWIGTITTGGSTFFASWAKGRFTISKTSTTVDLKITSPTTEDTATYFCARGGDTGYGFSYFDLWGQGTLVTVSS

SEQ ID NO: 150 - protein, 110 aa, Artificial Sequence
  VL
AVVLTQTPASVSEPVGGTVTIKCQASENIYSSLAWYQQKPGQPPKLLIYDASTLASGVPSRFKGSGSGTEYTLTISGVQSDDAATYYCQQGYSTSNLVNPFGGGTELVVN

SEQ ID NO: 151 - protein, 122 aa, Artificial Sequence
  VH
QSLEESGGDLVKPGASLTLTCTASGFSFSSDYYMCWVRQAPGKGLEWIACISAGSSGSIYYASWAKGRFTISKTSSTTVTLQMTSLTAADTATYFCAREASDSIYYPIFNLWGPGTLVTVSS

SEQ ID NO: 152 - protein, 112 aa, Artificial Sequence
  VL
AAVLTQTPSPVSAAVGGTVSISCQSSKSVYNNNALSWFQQKPGQPPKLLIYGASTLPSRVPSRFKGSGSGTQFTLTISDVQSDDAATYYCIGGYSSSSDTNAFGGGTEVVVK

SEQ ID NO: 153 - protein, 123 aa, Artificial Sequence
  VH
QSVEESGGRLVTPGTPLTLTCTVSGFSLSNYAMSWVRQAPGKGLEWIGIIYASGTTYYARWAKGRFTISRTSTTVDLKISSPTTEDTATYFCAREYDSYDYAYGSSIYAFDPWGPGTLVTVSS

SEQ ID NO: 154 - protein, 110 aa, Artificial Sequence
  VL
AYDMTQTPSSVSAAVGGTVTIKCQASESIYSNLAWYQQKPGQRPKLLIYRASTLASGVSSRFKGSGSGTQFTLSISGVESADAATYYCQQGYSSSNVDNVFGGGTEVVVK

SEQ ID NO: 155 - protein, 112 aa, Artificial Sequence
  VH
QSLEESGGRLVTPGTPLTLTCTASGFTISSHHVTWVRQAPGEGLEWIGVIYPSGTTYYASWAKGRFTISRTSTTVDLKMTSLTIEDTATYFCVRDVGYFTLWGQGTLVTVSS

SEQ ID NO: 156 - protein, 110 aa, Artificial Sequence
  VL
AQVLTQTPSPVSAAVGGTVTISCQSSQSVGGNNWLAWYQQKLGQPPKLLIYYASTLASGVPPRFSGSGSGTQFTLTISEVQSDDSATYYCQGYYSDVTNAFGGGTEVVVK

SEQ ID NO: 157 - protein, 124 aa, Artificial Sequence; identical to SEQ ID NO: 87
  VH

SEQ ID NO: 158 - protein, 110 aa, Artificial Sequence
  VL
AYDMTQTPASVEVAVGGTVTINCQASESIYSNLAWYQQKPGQPPKLLIYRASYLASGVSSRFKGSGSGTQFTLTISGVESADAATYYCQQGYSSSDVDNAFGGGTEVVVK

SEQ ID NO: 159 - protein, 119 aa, Artificial Sequence
  VH
QSLEESGGRLVTPGTPLTLICTASGIDLSSYGMTWVRQAPGKGLEWIGIISTIGDTYYASWVKGRFTISKTSTTVDLKITSPTTEDTATYFCARYTNSGYAMMYYFNLWGQGTLVTVSS

SEQ ID NO: 160 - protein, 113 aa, Artificial Sequence
  VL
DIVMTQTPASVEAAVGGTVTIKCQASQNIVNALAWYQQKLGQPPKLLIYVASYLASGVPSRFKGSGSGTEFTLTISDLESVDAATYYCQSYYYSSGTSYGQNAFGGGTEVVVK

SEQ ID NO: 161 - protein, 121 aa, Artificial Sequence
  VH
QEQLVESGGDLVKPGASLTLTCTASGIDFSSSYYMSWVRQAPGKGLEWIACIDTVDDYTYYASWAKGRFTISKTSSTTVSLQMTSLTAADTATYFCARERIDNNTDCFDLWGPGTLVTISS

SEQ ID NO: 162 - protein, 110 aa, Artificial Sequence
  VL
AQVLTQTPSPVSAAVGGTVTISCQSSQSVVSKNRLAWYQQKPGQPPKLLIWLASKLASGVPSRFRGSGSGTQFTLTISGVQSDDAATYYCQGYYSGAIYAFGGGTDVVVK

SEQ ID NO: 163 - protein, 116 aa, Artificial Sequence
  VH
QSLEESGGRLVTPGTPLTLTCTVSGIDLNNNAMSWVRQAPGEGLEWIGIISTAGTTTYASWTKGRFTISKTSTTVDLKITSPTTEDTATYFCARAAYFSYGYINLWGQGTLVTVSS

SEQ ID NO: 164 - protein, 108 aa, Artificial Sequence
  VL
DIVMTQTPASVEAAVGGTVTIKCQASQNIGNALAWYQQKSGQPPKLLIYSASTLASGVPSRFKGSGSGTEFTLTISDLESADATTYFCQSYVYSDGNVFGGGTEVVVK

SEQ ID NO: 165 - protein, 113 aa, Artificial Sequence
  VH
QSLEESGGRLVTPGTPLTLTCKVSGFSLSSYDMIWVRQAPGKGLEWIGIVSTGGSAGYASWAKGRFTITKTSTTVDLKITSPTTEDTATYFCARIISGGRDLWGPGTLVTVSS

SEQ ID NO: 166 - protein, 114 aa, Artificial Sequence
  VL
DIVMTQTPASVEAAVGGTVTIKCQASESISSRLAWYQQKPGQPPKLLIYSASTLAFGVSSRFKGSGSGTQFTLTISDLESADAATYYCQSYYYSSTASYASNNAFGGGTEVVVK

SEQ ID NO: 167 - protein, 117 aa, Artificial Sequence
  VH
QSVEESGGRLVTPGTPLTLTCTVSGFSLNTYVMSWVRQAPGKGLEWIGYIDYGGAPYYASWAKGRFTISKTSTTVELKITSPTIEDTATYFCARGGYGGYVLVTVLWGPGTLVTVSS

SEQ ID NO: 168 - protein, 110 aa, Artificial Sequence
  VL
DVVMTQTPASVSEPVGGTVTIKCQASQNIYSSLAWYQQKPGQPPKLLIYQASTLASEVPSRFKGSGSGTEFTLTINDLESADAATYYCQTYYGGSTYGNGFGGGTEVVVE

SEQ ID NO: 169 - protein, 117 aa, Artificial Sequence
  VH
QSLEESGGRLVTPGTPLTLTCTASGFSLSNYYITWVRQAPGEGLEWIGTISTAGNTYFASWAKGRFTISRTSTTVDLKMTSPTTEDTATYFCARDGAGDSNYYRNLWGQGTLVTVSS

SEQ ID NO: 170 - protein, 110 aa, Artificial Sequence
  VL
DIVLTQTPASVEAAVGGTVTIKCQASQSIDRFLAWYQQKPGQPPKLLIVDASTLESGVPSRFSGSGSGTEFTLTISDLESDNAATYYCQQGYSISDIDNVFGGGTEVVVK

SEQ ID NO: 171 - protein, 126 aa, Artificial Sequence
  VH
QEQLEESGGDLVQPEGSLTLTCTVSGFSFNSNYWICWVRQAPGKGLEWIACIMTGDGSTYYATWAKGRFTISKTSSTTVTLQMTSLTAADTATYFCARGYDGIHGGDNYGHVFNLWGPGTLVTVSS

SEQ ID NO: 172 - protein, 108 aa, Artificial Sequence
  VL
AFELTQTPFSVSAVVGGTVTINCQASENIYSLLAWYQQKPGQPPKLLIYRASTLASGVPSRFKGSGSGTQFTLIISDLESGDAATYYCQSYYINSSNSFGGGTEVVVK

SEQ ID NO: 173 - protein, 116 aa, Artificial Sequence
  VH
QSLEESGGDLVKPGASLTLTCTASEFDFNNNAMCWVRQAPGKGLEWIACIYIGNGGTWYASWAKGRFTISKSSSTTVTLQVTSLTAADTATYFCARGENIAYFILWGPGTLVTVSS

SEQ ID NO: 174 - protein, 113 aa, Artificial Sequence
  VL
DIVMTQTPASVSAAVGGTVTIKCQASQSINSWLSWYQQKPGQPPKLLIYKASTLASGVPSRFKGSGSGTEFTLTISDLESADAATYYCQGYYYYSSSNYASNAFGGGTEVVVK

SEQ ID NO: 175 - protein, 117 aa, Artificial Sequence
  VH
QSVEESGGRLVTPGTPLTLTCTVSGFSLSSYWMSWVRQAPGKGLEWIGFIYGGSGDKYYASWAKGRFAISKTSTTVDLKITSPTTEDTATYFCARGGDGDGTYSSLWGQGTLVTVSS

SEQ ID NO: 176 - protein, 109 aa, Artificial Sequence
  VL
AQVLTQTPSPVSAAVGGTVTISCQSSESVAGKNLAWYQQKPGQPPKVLIYGTSNLASRVPSRFRGSGSGTQFTLTISDLESDDAATYYCQGYYSGGIYGFGGGTEVVVE

SEQ ID NO: 177 - protein, 118 aa, Artificial Sequence
  VH
QSLEESGGRLVTPGGSLTLTCTVSGIDLSSYAMGWVRQAPGKGLEWIGYITYGGSTYYANWVNGRFTISKTSTMVDLKMTSLTAADTATYFCARLRAPYYYRIYFNLWGPGTLVTVSS

SEQ ID NO: 178 - protein, 108 aa, Artificial Sequence
  VL
ALVMTQTPSSVEAAVGGTVTIKCQASQNIISALAWYQQKPGQPPKLLIYDASNLESGVPSRFKGSGSGTDFTLTISDLESADAATYYCQGAYDTNINDFGGGTEVVVK

SEQ ID NO: 179 - protein, 120 aa, Artificial Sequence
  VH
QEQLEESGGDLVKPEGSLTLTCTASGFSFSSYWICWVRQAPGKGLEWIACIATHSGTDFYASWAKGRFTISKTSSTTVTLQMTSLTAADTATYFCARDPYGFNGDYFSLWGPGTLVTVSS

SEQ ID NO: 180 - protein, 112 aa, Artificial Sequence
  VL
ALVMTQTPASVSAAVGGTVTINCQASQSVYNSNYLSWYQQKPGQPPKLLIYKASTLASGVPSRFKGSGSGTQFTLTISGVESDDAATYYCAGYKSYTNDDNGFGGGTEVVVK

SEQ ID NO: 181 - protein, 115 aa, Artificial Sequence
  VH
QSVEESGGRLVTPGTPLTLTCTVSGFSLNNYGITWVRQAPGKGLEYIGYINYGGIAYYASWVNGRFTISKTSTTVDLKMTSLTAADTATYFCARGYGYYSAGNLWGQGTLVTVSS

SEQ ID NO: 182 - protein, 113 aa, Artificial Sequence
  VL
AQVLTQTPSPVSAAVGGTVTINCQASQSVYDNNYLSWYQQKPGQPPKRLIYDASSLASGVPSRFSGSGSGTQFTLTISGVQSDDAATYYCAGEYSCLSDDCIAFGGGTEVVVK

SEQ ID NO: 183 - protein, 118 aa, Artificial Sequence
  VH
QSVEESGGRLVTPGTPLTLTCTVSGFSLSNYYMTWVRQAPGKGLEYIGIIGSGVSTYYANWAKGRFTISKASSTTVDLKMTSPTTEDTATYFCARDMYVGNWGDWGLWGQGTLVTVSS

SEQ ID NO: 184 - protein, 110 aa, Artificial Sequence
  VL
AYDMTQTPASVEVAVGGTVTIKCQASQSISNNLNWYQQKPGQPPKLLIYSVSTLASGVPSRFKGSGSGTDYTLTISGVESVDAATYYCQQDYRIGDLDSAFGGGTEVVVK

SEQ ID NO: 185 - protein, 113 aa, Artificial Sequence
  VH
QEQLKESGGRLVKPDESLTLTCTASGFSLSRYDMSWVRQAPGKGLEWIGSIWSDGDTDYANWAKGRFTISKTSTMVDLKITSPTTEDTATYFCGRGYTAWNLWGPGTLVTVSS

SEQ ID NO: 186 - protein, 112 aa, Artificial Sequence
  VL
ALVMTQTPSPVSATVGGTLTISCQSSESVVGNNALSWFQQKPGQPPKLLIYQASTLASGVSSRFSGSGSGTQFTLTISGVQSDDAATYYCQGTYYSSGWYFAFGGGTEVVVK

SEQ ID NO: 187 - protein, 113 aa, Artificial Sequence
  VH
QEQLEESGGRLVTPGGTLTLTCTASGFSLNSYDMSWVRQAPGKGLEWIGYIWSDGNTDYASWAAGRFTASRASTTVDLKMTSLTTEDTATYFCARGYTGFFLWGPGTLVTVSS

SEQ ID NO: 188 - protein, 111 aa, Artificial Sequence
  VL
DVVMTQTPSSVSAAVGGTVTIKCQASQSIGSSYLSWYQQKPGQPPKLLIYEASTLASGVPSRFKGSGSGTEFTLTISDLESDDAATYYCQCTYYGGSWRVAFGGGTEVVVK

SEQ ID NO: 189 - protein, 122 aa, Artificial Sequence
  VH
QEQLVESGGGLVQPEGSLTLTCTSSGFSLNSNYYISWVRQAPGKGLEWIACIDAGSGSTWYASWVKGRFTISKTSSTTVTLQMTSLTAADTATYFCARDDIGTSYEYYFGLWGPGTLVTVSS

SEQ ID NO: 190 - protein, 108 aa, Artificial Sequence
  VL
DVVLTQTPASVSEPVGGTVTIKCQASQTISSYLAWYQQKSGQPPKLLIYSASTLASGVSSRFKGSGSGTEYTLTISDLESADAATYYCQTYYGSDSYVFGGGTEVVVK

SEQ ID NO: 191 - protein, 117 aa, Artificial Sequence
  VH
QSVEESGGRLVTPGTPLTLTCTVSGFSLSSNAMTWVRQAPGKGLEWIGFINTGSSTYYASWAKGRFTISKTSTTVDLKITSPTTEDTATYFCARDADDSRGYYWGLWGQGTLVTVSS

SEQ ID NO: 192 - protein, 111 aa, Artificial Sequence; identical to SEQ ID NO: 106
  VL

SEQ ID NO: 193 - protein, 119 aa, Artificial Sequence
  VH
QSLEESGGRLVTPGTPLTLTCTVSGIDLSSYAMGWVRQAPGKGLELIGLIYASNRTHYATWAKGRFTISKSSTTVDLKATSLTTEDTATYFCGRYGRGSGGYYYGMDLWGPGTLVTVSS

SEQ ID NO: 194 - protein, 112 aa, Artificial Sequence
  VL
DVVMTQTPASVEAAVGGTVTIKCQASQSGDNYLSWYQQKSGQPPKLLIYLASTLASGVPSRFRGSRSGTEYTLTISDLESADAATYYCQNYCAGSGVCVGVAFGGGTEVVVK

SEQ ID NO: 195 - protein, 132 aa, Artificial Sequence
  VH
QSLEESGGGLVKPEGSLTLTCTASGFSFSSSYWICWVRQAPGKGLEWIGCIYAGTFSDTFYASWTKGRFTISKTSSTTVTLQMTSLTGADTATYFCARGHYYYTDNYTANGYGRGLTRLDLWGQGTLVTVSS

SEQ ID NO: 196 - protein, 111 aa, Artificial Sequence
  VL
AAVLTQTPSPVSAAVGGTVTISCQASQSVYNNNNLAWYQQKAGQPPKLLIYGASNLESGVPSRFKGSGSGTQFTLTISDLESDDAASYYCAGGYTTSGDNGFGGGTEVVVK

SEQ ID NO: 197 - protein, 118 aa, Artificial Sequence
  VH
QSVEESGGRLVTPGTPLTLTCTVSGFSLSSYDMIWVRQAPGKGLEWIGIIYLTDTTYYANWAKGRFTISKTSTTVDLKISSPTTEDTATYFCARHLDTSSGGFYFNLWGQGTLVTVSS

SEQ ID NO: 198 - protein, 113 aa, Artificial Sequence
  VL
AQVLTQTPSSVSAAVGGTVTINCQASQSVYNSKILAWYQQKPGRPPKLLIYDASTLASGVPSRFKGSGSGTQFTLTISGVQSDDAATYFCQGEFTCTSADCIAFGGGTEVVVK

SEQ ID NO: 199 - protein, 116 aa, Artificial Sequence
  VH
QSVEESGGRLVTPGTPLTLTCIVSGIDLSSNAMSWVRQAPGKGLEWIGIIGFAGITYYANWAKGRFTISKTSTTVDLKITSPTTEDTATYFCARAYGDSDGLYNLWGQGTLVTVSS

SEQ ID NO: 200 - protein, 110 aa, Artificial Sequence
  VL
AQVLTQTASSVSAAVGGTVTISCQSSESVYNNNWLGWFQQKPGQPPKLLIYLASTLASGVPSRFKGSGSGTQFTLTISDLESDDAATYYCQGGYSGNIFAFGGGTEVVVN

SEQ ID NO: 201 - protein, 124 aa, Artificial Sequence
  VH
QSLEESGGGLFQPGGSLTLTCKASGLDFSTNYYMCWVRQAPGKGLELIACISTSSGNTWYASWAKGRFTISKTSSTTVTLQMTSLTAADTATYFCARCDIVYVGYGYASRLDLWGQGTLVTVSS

SEQ ID NO: 202 - protein, 110 aa, Artificial Sequence
  VL
AQVLTQTPSPVSAAVGGTVTINCQASESVYNNNNLAWYQQKPGQPPKFLIYGASSLASGVPSRFKGSGSGTQFTLTISDLESDDAATYYCAGGGSTSVGAFGGGTEVVVK

SEQ ID NO: 203 - protein, 119 aa, Artificial Sequence
  VH
QQQLEESGGGLVKPGGTLTLPCKASGFTISSDYDMCWVRQAPGKGLEWITCILGGSGGSTWYANWAKGRFTISQSSSTTVTLQMTSLTDADTATYFCTRASGFTYFELWGPGTLVTVSS

SEQ ID NO: 204 - protein, 113 aa, Artificial Sequence
  VL
AQVLTQTPSSVSAAVGGTVTINCQASQSVYNNKNLAWYQQKPGQPPKLLIYYASTLASGVSSRFKGSGSGTQFTLTISDVQSDDAATYYCQGEFSCSSSDCFAFGGGTEVVVK

SEQ ID NO: 205 - protein, 123 aa, Artificial Sequence
  VH
QSLEESGGRLVKPDETLTLTCTVSGFDLSSYAVVWVRQAPGKGLEWIGYIYGGSGSTWYASWAKGRFTISKTSSTTVDLKMTSLTTEDTATYFCARAYDSGYIGNSFYAFDPWGPGTLVTVSS

SEQ ID NO: 206 - protein, 108 aa, Artificial Sequence
  VL
DIVMTQTPASVSAAVGGTVTIKCQASQTISSTLAWYQQKPGQPPKLLIYSASTLASGVSSRFKGSGSGPEFTLTISDLESADGGTYTCAGYGTVGVTAFGGGTEVVVR

SEQ ID NO: 207 - protein, 117 aa, Artificial Sequence
  VH
QSLEESGGRLVTPGTPLTLTCTASGFSLSSYYMTWVRQAPGEGLEWIGTISTAGNTYFASWVKGRFTISRTSTTVDLKMTSPTTEDTATYFCTRDGAGDSNYYRNLWGQGTLVTVSS

SEQ ID NO: 208 - protein, 110 aa, Artificial Sequence
  VL
AIDMTQTPASVEAAVGGTVTIKCQASESIDRFLAWYQQKPGQPPKLLIVDASTLESGVPSRFSGSGSGTEFTLTISDLESDNAATYYCQQGYAISDIDNVFGGGTEVVVK

SEQ ID NO: 209 - protein, 116 aa, Artificial Sequence
  VH
QSLEESGGRLVTPGTPLTLTCTVSGIDLNNNAMTWVRQAPGEGLEWIGIISTADTTSYASWTKGRFTISKTSTTVDLKITSPTTEDTATYFCARAAYFSYGYFNLWGQGTLVTVSS

SEQ ID NO: 210 - protein, 108 aa, Artificial Sequence
  VL
DIVMTQTPASVEAAVGGTVTIKCQASQNIGNALAWYQQKSGQPPKLLIYGASTLASGVPSRFKGSGSGTEFTLTISDLESADATTYFCQSYVYSDGNVFGGGTEVVVK

SEQ ID NO: 211 - protein, 126 aa, Artificial Sequence
  VH
QEQLEESGGDLVQPEGSLTLTCTVSGFSFDSNYWICWVRQAPGKGPEWIACIMTGDGSIYYATWAKGRFTISKTSSTTVTLQMTSLTAADTATYFCARGYDGIHGGDNYGHVFNLWGPGTLVTVSS

SEQ ID NO: 212 - protein, 108 aa, Artificial Sequence
  VL
AFELTQTPFSVSAVVGGTVTINCQASENIYTLLAWYQQKSGQPPKLLIYRASTLTSGVPSRFKGSGSGTQFTLTISDLESADAATYYCQGYYVDSGNTFGGGTEVVVK

SEQ ID NO: 213 - protein, 117 aa, Artificial Sequence
  VH
QSLEESGGRLVTPGTPLTLTCTASGFSLSSYYMTWVRQAPGEGLEWIGTISTAGNTYFASWAKGRFTISRTSTTVDLKMTSPTTEDTATYFCARDGAGDSNYYRNLWGQGTLVTVSS

SEQ ID NO: 214 - protein, 110 aa, Artificial Sequence
  VL
AYDMTQTPASVEAAVGGTVTIKCQASESIDRFLAWYQQKPGQPPKLLIVDASTLESGVPSRFSGSGSGTEFTLTISDLESDNAATYYCQQGYSISDIDNVFGGGTEVVVK

SEQ ID NO: 215 - protein, 122 aa, Artificial Sequence
  VH
QSLEESGGDLVRPGASLTLTCTASGLSFSDRYWISWVRQAPGKGLEWIASIYTGSDGVADYATWAKGRVTISKTSSTTVTLQMTSLTAADTATYFCARDREYGSNTGVYSLWGPGTLVTVSS

SEQ ID NO: 216 - protein, 109 aa, Artificial Sequence
  VL
DVLMTQTPSSVSPAVGGTVTIKCQASQNIYSNLAWYQQKPGQRPKLLVYDASNLEYGVPSRFKGSGSGTEYTLTISDLESADAANYYCQCTYYGNNYITFGGGTEVVVR

SEQ ID NO: 217 - protein, 114 aa, Artificial Sequence
  VH
QQQLEESGGGLVKPEGSLTLTCKASGFTLSSYLMCWVRQAPGKGLELIGCIGTYSGATYYGSWAKDRFTIAKTSSTTVTLQMTSLTAADTATYFCARDYNFALWGPGTLVTVSS

SEQ ID NO: 218 - protein, 112 aa, Artificial Sequence
  VL
AIVMTQTPSSKSVPVGDTVTINCQASESVYNNNYLSWFQQKPGQPPKLLIYGASTLTSGVPSRFKGSGSGTQFTLTISDVVSDDAATYYCAGYKSSWTDGNAFGGGTEVVVK

SEQ ID NO: 219 - protein, 117 aa, Artificial Sequence
  VH
QSVEESGGRLVTPGTPLTLTCAASGFSLNSYVMSWVRQAPGKGLEWIGYIDYGGAPYYASWAKGRFTISKTSTTVELKITSPTIEDTGTYFCARGGYGGYVLVTALWGPGTLVTVSS

SEQ ID NO: 220 - protein, 110 aa, Artificial Sequence
  VL
DIVMTQTPASVSEPVGGTVTIKCQASENIYSYLAWYQQKPGQPPKLLIYQASTLASGVSSRFKGSGSGTQFTLTISDLESADAATYYCQTYYGGSTYGNGFGGGTEVVVE

SEQ ID NO: 221 - protein, 120 aa, Artificial Sequence
  VH
QEKLEESGGGLVKPGGSLTLPCTASGFTLSSRYYMCWVRQAPGKGLEWIGCIYAGSLRTWYASWAKGRFTISKTSSTTVTLQMTSLTAADTATYFCARSPGVAASYPELWGPGTLVTVSS

SEQ ID NO: 222 - protein, 113 aa, Artificial Sequence
  VL
AQVLTQTPSSVAAAVGGTVSISCQSSQSVGNADNLAWYQQKPGQPPNLLIYYAASLASGVPSRFKGSGSGTQFTLTISDLESDDAATYYCGGGYYNSTDTFYTFGGGTEVVVK

SEQ ID NO: 223 - protein, 121 aa, Artificial Sequence
  VH
QSLEESGGDLVQPEGSLTLTCKASGFDFSSTYWICWVRQAPGKGLEWIGCIDDSYAYTYYASWAKGRFTISKPSSTTVTLQVTSLTVADTATYFCARDGYPGYGVGSFNLWGPGTLVTVSS

SEQ ID NO: 224 - protein, 112 aa, Artificial Sequence
  VL
AIVMTQTPSSKSVPVGDTVTINCQASESVYSNNRLAWFQQKPGQPPKLLIYLASTLASGVPSRFKGSGSGTQFTLTISDVVSDDAATYYCAGYKSYSDDGTGFGGGTEVVVK

SEQ ID NO: 225 - protein, 117 aa, Artificial Sequence
  VH
QSVEESGGRLVTPGTPLTLTCTVSGFSLSSYVMSWVRQAPGKGLEWIGYIDYGGAPYYASWAKGRFTISKTSTTVELKITSPTIEDTATYFCARGGYGGYVLVTVLWGPGTLVTVSS

SEQ ID NO: 226 - protein, 110 aa, Artificial Sequence
  VL
DVVMTQTPASVSEPVGGTVTIKCQASQNIYSSLAWYQQKPGQPPKLLIYQASRLASEVPSRFKGSGSGTEFTLTISDLESADAATYYCQTYYGGSTYGNGFGGGTEVVVE

SEQ ID NO: 227 - protein, 125 aa, Artificial Sequence
  VH
QEHLEESGGDLVKPGASLTLTCKASGFDLSINVMCWVRQAPGKGPEWIVCIDNGDGSTYYASWVNGRFTISKTSSTTVTLQMTSLTAADTATYFCARPGTFTYGGNTYPGSFVLWGPGTLVTVSS

SEQ ID NO: 228 - protein, 109 aa, Artificial Sequence
  VL
AFELTQTPSSVEAAVGGTVTINCQASQSISNALAWYQQKPGQPPKLLIYTASNLASGVPSRFKGSGSGTQFTLTISDLESADAATYYCQNYYVNIIGIGFGGGTEVVVK

SEQ ID NO: 229 - protein, 116 aa, Artificial Sequence
  VH
QSVEESGGRLVTPGTPLTLTCTVSGFSLSSYAMGWVRQAPGKGLEWIGDIYGSGSTYYASWAKGRFTFSRTSTTVDLKMTSLTTEDTATYFCARSKGYNYNLWNLWGQGTLVTVSS

SEQ ID NO: 230 - protein, 111 aa, Artificial Sequence
  VL
DIVMTQTPSSVSAAVGGTVTINCQASQNIYTNLAWYQQKPGQRPKLLIYDASDLASGVPSRFSGSGSGTEYTLTISDLESADAATYYCQTYSYSGSSSANPFGGGTEVVVK

SEQ ID NO: 231 - protein, 118 aa, Artificial Sequence
  VH
QSVEESGGRLVTPGTPLTLTCTVSGFSLSSYDMIWVRQAPGKGLEWIGIIYLTDTTYYANWTKGRFTISKTSTTVDLKISSPTTEDTATYFCARHLDTSSGGFYFNLWGQGTLVTVSS

SEQ ID NO: 232 - protein, 113 aa, Artificial Sequence; identical to SEQ ID NO: 198
  VL

SEQ ID NO: 233 - protein, 120 aa, Artificial Sequence
  VH
QSLEESGGDLVKPGASLTLTCTASEFSFSNNYYICWVRQAPGKGLEWIACIYVHSGTTDYATWAKGRFTISRTSSTTVTLQMTSLTVADTATYFCARGRSGYYADAFDTWGPGTLVTVSS

SEQ ID NO: 234 - protein, 112 aa, Artificial Sequence
  VL
ALDMTQTPSPVSAAVGGTVTINCQASQSVYNNNNLAWYQQKPGQPPKLLIYLASNLASGVPSRFKGSGSGTQFTLTISEIQSDDAATYYCQGTDSSSGWEHAFGGGTEVVVK

SEQ ID NO: 235 - protein, 125 aa, Artificial Sequence
  VH
QEQLVESGGDLVKPGTSLTLTCKASGLDFSSTPYMCWVRQAPGKGLEWIACIYTGSVIYTYYASWAKDRFTISKISSTSVTLQMTSLTVADTATYFCARSPAGYAAYGYGGFNLWGPGTLVTVSS

SEQ ID NO: 236 - protein, 111 aa, Artificial Sequence
  VL
AIEMTQTPFSVSAAVGGTVTINCQASQNIYNNLAWYQQKPGQPPKLLIYGASTLESGVPSRFEGSGSGTEYTLTISDLESDDAATYYCQSAYYSSSATDMAFGGGTEVVVK

SEQ ID NO: 237 - protein, 119 aa, Artificial Sequence
  VH
QSVEESGGRLVTPGTPLTLTCTASGFSLSSYHMCWVRQAPGKGLEWIGIIYAGSGNTWYASWAKGRFTISKTSTTVDLKITSPTTEDTATYFCARQPGGGASDTQLDLWGQGTLVTVSS

SEQ ID NO: 238 - protein, 111 aa, Artificial Sequence
  VL
AAVLTQTPSPVSAAVGGTVTINCQSSQSVFDNNQLSWFQHKPGQSPKLLIYRASTLASGVPSRFKGSGSGTQFTLTISDLESDDAATYYCLGGYSSSSDTVFGGGTEVVVE

SEQ ID NO: 239 - protein, 121 aa, Artificial Sequence
  VH
QEQLVESGGGLVQPEGSLTLTCTASGFSFSSRFWICWVRQAPGKGLEWIACIYGGSTSATYDASWAKGRFTISKTSSTTVTLQMTSLTAADTATYFCTRLPTYDAYVFNLWGPGTLVTVSS

SEQ ID NO: 240 - protein, 112 aa, Artificial Sequence
  VL
AIVMTQTPSSKSVPVGATATINCQASESVFSNNYLSWYQQKPGRSPKLLIYEASKLASGVPSRFSGSGSGTQFTLTISDVVSDDAATYYCGGYKSNNVDGYAFGGGTEVVVK

SEQ ID NO: 241 - protein, 114 aa, Artificial Sequence
  VH
QSVEESGGRLVTPGTPLTLTCTVSGFSLNHYHMCWVRQAPGKGLEYIGRIDNSGYIVYASWAKGRFTISKTSTTVDLKITSPTTADTATYFCGKYYSGGSYDLWGQGTLVTVSS

SEQ ID NO: 242 - protein, 113 aa, Artificial Sequence
  VL
AQVLTQTASSVSAAVGGTVTISCQSSQSVWNNNWLAWYQQKPGQPPKLLIYETSKLASGVPSRFKGSGSGTQFTLTISGVQSDDAATYYCQGEFSCSSDDCNAFGGGTEVVVK

SEQ ID NO: 243 - protein, 118 aa, Artificial Sequence
  VH
QEQLKESGGGLVTPGGTLTLTCTVSGFSLSGHDMGWVRQAPGKGLEWIGIIGSNSKTYYTNWAKGRFTISKTSTTVGLRITSPTTEDTATYFCTVVGPGVGGFYFDLWGQGTLVTVSS

SEQ ID NO: 244 - protein, 110 aa, Artificial Sequence
  VL
DVVMTQTPASVSDPVGGTVTIRCQASQSIGSDLAWYQQKPGQPPKLLIYAASTLASGVPSRFSGSGSGTEYTLTISDLESADAATYYCQCTYVGSTYLGAFGGGTEVVVK

SEQ ID NO: 245 - protein, 117 aa, Artificial Sequence
  VH
QSLEESGGRLVTPGGSLTLTCTVSGIDLSSYAMGWVRQAPGKGLEWIGIISSSGSTYYASWANGRFTISKTSTTVDLKVTSPTTEDTATYFCARDGDSGRGYYFHFWGQGTLVTVSS

SEQ ID NO: 246 - protein, 111 aa, Artificial Sequence
  VL
AFELTQTPASVSAAVGGTVTIKCQASEDIYSLLAWYQQKPGQPPKLLIYDASDLASGVPSRFSGSGSGTEYTLTISDLESADAAIYYCQQGYTTVTIVDNVFGGGTEVVVK

SEQ ID NO: 247 - protein, 118 aa, Artificial Sequence
  VH
QSLEESGGDLVKPEGSLTLTCTASGFSFSSSYWICWVRQAPGKGLEWIGCMITGRGNTYYATWAKGRFTISKTSSTTVTLQMTSLTAADTATYFCARGPGGADPINLWGPGTLVTVSS

SEQ ID NO: 248 - protein, 111 aa, Artificial Sequence
  VL
DVVMTQTPASVSEPVGGTVTIKCQASQNIYNNLAWYQQKPGQPPKLLIYLASTLASGVPSRFEGSGSGTEFTLTISGVQSDDAATYYCQSTYDGSSYVPNAFGGGTEVVVK

SEQ ID NO: 249 - protein, 119 aa, Artificial Sequence
  VH
QSLEESGGRLVTPGTPLTLTCTVSGIDLSSYAMGWVRQAPGKGLELIGLIYASDRTHYATWAKGRFTISKSSTTVDLKATSLTTEDTATYFCGRYGRGSGGYYYGMDLWGPGTLVTVSS

SEQ ID NO: 250 - protein, 112 aa, Artificial Sequence; identical to SEQ ID NO: 194
  VL

SEQ ID NO: 251 - protein, 123 aa, Artificial Sequence
  VH
QSLEESGGRLVTPGGSLTLTCTVSGIDLSSYAMIWVRQAPGKGLEWIGYIYGGSGSTWYASWAKGRFTISKTSSTTVDLKMTSLTTEDTATYFCARAYDSGYIGNSFYIFDPWGPGTLVTVSS

SEQ ID NO: 252 - protein, 108 aa, Artificial Sequence
  VL
DIVMTQTPASVSATVGGTVTIKCQASQSISSRLAWYQQKPGQPPKLLIYSASTLASGVSSRFRGSGSGTEFTLTISDLESADGATYYCAGYGGLGITAFGGGTEVVVK

SEQ ID NO: 253 - protein, 117 aa, Artificial Sequence
  VH
QSLEESGGRLVTPGTPLTLTCTASGFSLSNYYITWVRQAPGEGLEWIGTISTAGNTYFASWANGRFTISRTSTTVDLKMTSPTTEDTATYFCARDGAGDSNYYRNLWGQGTLVTVSS

SEQ ID NO: 254 - protein, 110 aa, Artificial Sequence; identical to SEQ ID NO: 170
  VL

SEQ ID NO: 255 - protein, 119 aa, Artificial Sequence
  VH
QSLEESGGRLVTPGTPLTLTCTVSGFSLSSHAMSWVRQAPGKGLEYIGIIDTDASASYASWAKGRFTISRTSTTVDLKITSPTTEDTATYFCARDGGYTDYSYYAMDLWGPGTLVTVSS

SEQ ID NO: 256 - protein, 110 aa, Artificial Sequence
  VL
DIVMTQTPASVEAAVGGTVTIKCQASETIYVNLAWYQQKPGQPPKLLIYRASTLASGVSSRFKGSGSGTEFTLTISDVKSVDAATYYCHQAYRRSDVGNIFGGGTEVVVK

SEQ ID NO: 257 - protein, 112 aa, Artificial Sequence
  VH
QSVEESGGRLVTPGTPLTLTCTVSGFSLSSYDMSWVRQAPGKGLEWIGWITTDGGTDYASWAKGRFTVSKASTTVDLKITSPTTEDTATYFCARGYASFNLWGQGTLVTVSS

SEQ ID NO: 258 - protein, 112 aa, Artificial Sequence
  VL
AQVLTQTPSSVSAAVGGTVTINCQSSQSVLSNSYLAWYQQKPGQPPKLLIYAASSLASGVPSRFKGSGSGTQFTLTISDLESDDAATYYCQGTDYSGGWYVAFGGGTEVVVK

SEQ ID NO: 259 - protein, 119 aa, Artificial Sequence
  VH
QSLEESGGRLVTPGTPLTLTCTVSGIDLSSYAMGWVRQAPGKGLEYIAIIYTTNRTHYATWAKGRFTISKSSTTVDLKATSLTTEDTATYFCGRYGRGSGGYYYGMDLWGPGTLVTVSS

SEQ ID NO: 260 - protein, 112 aa, Artificial Sequence; identical to SEQ ID NO: 78
  VL

SEQ ID NO: 261 - protein, 118 aa, Artificial Sequence
  VH
QEQLVESGGGLVQPEGSLTLTCKASGFDFSSDAMCWVRQAPGKGLEWIACIYVGSVGSSWYASWAKGRFTISKSSSTTVTLQVTSLTAADTATYFCARGENIAYFTFWGPGTLVTVSS

SEQ ID NO: 262 - protein, 113 aa, Artificial Sequence
  VL
DIMMTQTPASVSAAVGGTVTIKCQASQSINSWLSWYQQKPGQPPKLLIYKASTLASGVPSRFEGSGSGTEFTLTISDLESADAATYYCQGYYYYSSSNFASNAFGGGTEVVVK

SEQ ID NO: 263 - protein, 112 aa, Artificial Sequence
  VH
QSLEESGGRLVTPGTPLTLTCTVSGLSLSSYDMSWVRQAPGKGLEWIGYIWSGGSTDYASWAKGRFTISKTSTTVDLKIISPTTEDTATYFCARGYVEFDLWGPGTLVTVSS

SEQ ID NO: 264 - protein, 112 aa, Artificial Sequence
  VL
DPVLTQTPPSVSAAVGGTVTINCQSSQSLYSNNYLSWYQQKAGQPPKVLIWPASSLASGVPSRFKGSASGTQFTLTISELQSDDAATYYCQGTFYDSGWLSAFGGGTEVVVK

SEQ ID NO: 265 - protein, 118 aa, Artificial Sequence
  VH
QSLEESGGRLVTPGTPLTLTCTASGFSLNSYYINWVRQAPGKGLEWIGFINGYDNTWYASWAKGRFTISRTSTTVDLRITSPTTEDTATYFCARDPGGASGTGRLDLWGQGTLVTVSS

SEQ ID NO: 266 - protein, 110 aa, Artificial Sequence
  VL
DIVMTQTPASVSAAVGGTVTINCQASQSISTALAWYQQKPGQRPKLLIYDASKLASGVPSRFKGNGSGTEFTLTISDLESADAATYYCQCTYYDAYDVGAFGGGTEVVVN

SEQ ID NO: 267 - protein, 119 aa, Artificial Sequence
  VH
QSLEESGGDLVQPGASLTLTCKASGIDLSSYWMCWVRQTPGKGLEWIGCIATYSSVTYYANWAKGRFTISKPSSTTVTLQMTSLTAADTATYFCARDPYSFNGSLFTLWGPGTLVTVSS

SEQ ID NO: 268 - protein, 110 aa, Artificial Sequence
  VL
ALVMTQTASPVSAAVGGTVTIDCQASQNIGTYLAWYQQKPGQPPKLLIYTASSLASGVPSRFKGSGSGTQFTLTISDLESDDAATYYCAGYKNYNNDDNGFGGGTEVVVK

SEQ ID NO: 269 - protein, 112 aa, Artificial Sequence
  VH
QSVEESGGRLVTPGTPLTLTCTVSGFSLNNYDMNWVRQAPGKGLEWVGYIDTGGSAYYANWVNGRFTISKTSTTVELKMTSLTASDTATYFCARGYIHGYLWGQGTLVTVSS

SEQ ID NO: 270 - protein, 111 aa, Artificial Sequence
  VL
ALVMTQTPSSVSAAVGGTVTINCQASQNVYNNLAWYQQRPGQPPELLIDSASTLASGVSSRFKGSGSGTEFTLTISDLESADAATYYCQSADWESSNFFWAFGGGTEVVVK

SEQ ID NO: 271 - protein, 117 aa, Artificial Sequence
  VH
QSLEESGGRLVTPGTPLTLTCTASGFSLSSYGMIWVRQAPGKGLEWIGMIIDVTYTYYASWAKGRFTISKTSTTVDLKMTSLTTEDTATYFCARTPGYGIYAYGNLWGQGTLVTVSS

SEQ ID NO: 272 - protein, 110 aa, Artificial Sequence
  VL
AQVLTQTPSPVSAAVGGTVTISCQSSQSVYGNNWLAWYQQKPGQPPKLLIYYASTLASGVPSRFKGSGSGTQFTLTISEVQSDDAATYYCQGYYSSAAYVFGGGTEVVVK

SEQ ID NO: 273 - protein, 117 aa, Artificial Sequence
  VH
QSVEESGGRLVMPGTPLTLTCTVSGFSLSTYVMGWVRQAPGKGLECIGVIYGGGTIWYASWAKGRFTISKTSTTMDLQITSPTTEDTATYFCARDGSSSGDPGFNLWGQGTLVTVSS

SEQ ID NO: 274 - protein, 109 aa, Artificial Sequence
  VL
DIVMTQTPASVSAAVGGTVTINCQASQSISNWVAWYQQKPGQPPKRLIYKASTLASGVPSRFKGSGSGTEFTLTISDLESADAATYYCQSTGSTAYGRAFGGGTEVVVR

SEQ ID NO: 275 - protein, 114 aa, Artificial Sequence
  VH
QSVEESGGRLVTPGTPLTLTCTVSGFSLSHYHILWVRQAPGEGLKYIGITLNNGRIDYATWAKGRFTISKTSTTVDLEITSPTTEDTATYFCAKYFVSESYDLWGQGTLVTVSS

SEQ ID NO: 276 - protein, 111 aa, Artificial Sequence
  VL
TAVLTQTPSPVSAAVGSTVTINCQASQSVYNDNWLSWYQQKPGQPPKLLIYGASTLASGVPSRFKGSGSGTQFTLTISDVQSGDAATYYCLGGYKDNSDNVFGGGTEVVVK

SEQ ID NO: 277 - protein, 112 aa, Artificial Sequence
  VH
QSLEESGGRLVTPGGSLTLTCTVSGIDLSSYDMNWVRQAPGEGLEWIGAISTGGDTHYTNWAKGRFTISKTSTTVDLKMTSLTAADTATYFCARGYYTLALWGQGTLVTVSS

SEQ ID NO: 278 - protein, 111 aa, Artificial Sequence
  VL
DPVLTQTPASVEAAVGGTVTIKCQASQSINSWLSWYQQKPGQPPKRLIYDTSTLESGVPSRFSGGESGTEFTLTISDLESDDAATYYCQSYYYITSSYAITFGGGTEVVVK

SEQ ID NO: 279 - protein, 119 aa, Artificial Sequence
  VH
QSVEESGGRLVTPGTPLTLTCTVSGSDISGYALGWVRQAPGKGLEYIGVIAADGNAYYASWAKGRFTISRTSTTVDLKMTSLTTEDTATYFCARGYSSGWGTYGYFDLWGQGTLVTVSS

SEQ ID NO: 280 - protein, 112 aa, Artificial Sequence
  VL
DIVMTQTPASVSAAVGGTVTIKCQASEDIYSYLAWYQQKPGQPPKLLIYRASTLESGVPSRFKGSGSGTQFTLTISDLESADAATYYCQSYYYSHSTTYSNVFGGGTEVVVK

SEQ ID NO: 281 - protein, 118 aa, Artificial Sequence
  VH
QSVEESGGRLVTPGTPLTLTCTVSGFSLSTYAMSWVRQAPGKGLEWIGMNTRSGIIYYASWAKGRFTISKTSTTVHLKITSPTTEDTATYFCARDLYADVSGYYLGLWGPGTLVTVSS

SEQ ID NO: 282 - protein, 113 aa, Artificial Sequence
  VL
AQVLTQTPSSVSAAVGGTVTINCQASQSLYNNKNLAWYQQKPGQPPKLLIYYASTLASGVSSRFKGSGSGTQFTLTISDLESDDAATYYCQGEFICSSADCVVFGGGTAVVVK

SEQ ID NO: 283 - protein, 117 aa, Artificial Sequence
  VH
QSLEESGGRLVTPGTPLTLTCTASGFSLSYYYMTWVRQAPGKGLEWIGITGGGGDTYYGTWAKGRFTISKTSTTVDLKMTSPTTEDTATYFCARGTDGAAHTGFALWGQGTLVTVSS

SEQ ID NO: 284 - protein, 111 aa, Artificial Sequence
  VL
DIVMTQTPASVEAAVGGTVTIKCQASEDISSRLSWYQQKPGQPPKLLIYLASTLASGVPSRFKGSGSGTQFTLTISDLESADAATYYCQSSSYGTSTIYGTFGGGTEVVVK

SEQ ID NO: 285 - protein, 120 aa, Artificial Sequence
  VH
QSVEESGGRLVTPGTPLTLTCTASGFSLSNFYMSWVRQAPGKGLEWIGIISTGGSAYYASWAKGRFTSSKTSTTVDLQITSPTTEDTATYFCARGSGTDGAWLYYGIDLWGPGTLVTVSS

SEQ ID NO: 286 - protein, 111 aa, Artificial Sequence
  VL
DVVMTQTPASVEAAVGGTVTIKCQASENIGHALAWYQQKPGQPPKLLIYRTSTLASGVPSRFSGSGSGTQFSLTISDLDSADAATYFCQINYGGGSGGYFAFGGGTEVVVK

SEQ ID NO: 287 - protein, 122 aa, Artificial Sequence
  VH
QEQLVESGGGLVQPEGSLTLTCTASGFSFSSSYYMCWVRQAPGKGPEWIACIYTYSGDTDYANWAKGRFTISKTSSTTVTLQMTSLTAADTATYFCAKAGYGGYGYPIFNLWGPGTLVTVSS

SEQ ID NO: 288 - protein, 111 aa, Artificial Sequence
  VL
AFELTQTPSSVEAAVGGTVTIKCQASQSIGSSLAWYQQKPGQRPKLLMYYVSTLASGVSSRFKGSGSGTEFTLTISDLESADAATYYCQSYYGSGTTVFWAFGGGTEVVVK

SEQ ID NO: 289 - protein, 121 aa, Artificial Sequence
  VH
QSVEESGGRLVTPGTPLTLTCTVSGFSLSSYAMSWVRQAPGKGLEWIGYIWSGGTTDYASWAKGRFTISKTSTTVDLKITDPTTEDTATYFCARGLGDRGSSDYYMPLKLWGQGTLVTVSS

SEQ ID NO: 290 - protein, 111 aa, Artificial Sequence
  VL
AAVLTQTPSPVSAAVGGTVTINCQASEDIESYLAWYQQKPGQPPKLLIYSTSNLASGVSSRFRGSGSGTQLTLTISDLESADAATYYCQCTYDGSSAVWGAFGGGTEVVVK

SEQ ID NO: 291 - protein, 113 aa, Artificial Sequence
  VH
QEQLKESGGGLVQPGESLTLTCTASGFSLSSYYMSWVRQAPGKGLEWIGMISTGGSAYYANWARGRFTISRTSTTVDLKVTSLTTEDTATYFCARGWRYEDLWGQGTLVTVSS

SEQ ID NO: 292 - protein, 112 aa, Artificial Sequence
  VL
AQVLTQTPSPVSAAVGSTVTINCQSSQTVYNNNYLAWYQQKPGQPPKLLIYDASNLASGVSSRFSGSGSGTQFTLTISDLESDDAATYYCQGTYYDNAWYHTFGGGTEVVVK

SEQ ID NO: 293 - protein, 117 aa, Artificial Sequence
  VH
QSVEESGGRLVTPGTPLTLTCTVSGIDLSSYVMSWVRQAPGKGLEWIGYIDYGGTAYYASWAKGRFTISKTSTTVELKITSPTIEDTATYFCARGGYGGYTLVTALWGPGTLVTVSS

SEQ ID NO: 294 - protein, 110 aa, Artificial Sequence
  VL
DIVMTQTPASVSEPVGGTVTIKCQASQSISSYLSWYQQKPGQPPKLLIYSTSTLASGVSSRFKGSGSGTEYTLTISDLESADAATYYCQTYYGGGPFGNGFGGGTEVVVK

SEQ ID NO: 295 - protein, 117 aa, Artificial Sequence
  VH
QSVEESGGRLVTPGTPLTLTCTVSGFSLSSYGMIWVRQAPGKGLEWIGWISSNDNKYYARWAKGRFTISKTSTTVDLKMTSLTTEDTATYFCVRNGVYNTGNYFDLWGQGTLVTVSS

SEQ ID NO: 296 - protein, 113 aa, Artificial Sequence
  VL
AQVLTQTPSSVSAAVGGTVTINCQASQSLYNNKNLAWYQQKPGQPPKFLIYTASSLASGVSSRFKGSGSGTQFTLTISDVQSDDAATYYCQGEFDCDSDDCFAFGGGTEVVVK

SEQ ID NO: 297 - protein, 116 aa, Artificial Sequence
  VH
QSVEESGGRLVTPGTPLTLTCTVSGFSLSTYAMGWVRQAPGKGLEWIGIIYTGGSTYYASWAEGRFTISKTSTTVDLKITSPTPEDTATYFCTRDLGATYDYFDLWGQGTLVTVSS

SEQ ID NO: 298 - protein, 110 aa, Artificial Sequence
  VL
AYDMTQTPASVEVAVGGTVTIKCQASQSISTALAWYQQKPGQRPKLLIYDTSDLASGVPSRFSGSGSGTEFTLTISGVESADAATYYCQQGYRHTNVDNPFGGGTGVVVK

SEQ ID NO: 299 - protein, 117 aa, Artificial Sequence
  VH
QSLEESGGRLVTPGTPLTLTCTASGFSLSKYDMGWFRQAPGKGLEWIGMIGASDRTYYASWVKGRFTISKTSTTVDLRITSPTTEDTATYFCAREYPDARGYYYNLWGPGTPVTVSS

SEQ ID NO: 300 - protein, 110 aa, Artificial Sequence
  VL
ALVMTQTPASVEAAVGGTVTINCQASQSISDLLAWYQQKPGQPPKLLIYDASDLASGVPSRFSGSGSGTEFTLTISGVQSDDAATYYCQQGYSITNVDNVFGGGTEVVVK

SEQ ID NO: 301 - protein, 122 aa, Artificial Sequence
  VH
QSVEESGGRLVTPGTPLTLTCTVSGFSLSSNAISWVRQAPGKGLEWIAIITHSDNTFYASWAKGRFTISKASTTVDLKVTSPTTEDTATYFCARDGYVSSSGTYMGGYFDLWGQGTLVTVSS

SEQ ID NO: 302 - protein, 113 aa, Artificial Sequence
  VL
DPVLTQTPSPVSAAVGGTVTINCQASQIIYNDKNLAWYQQKPGQPPKLLIYYASTLASGVSSRFKGSASGTQFTFTISGVQSDDAATYYCQGEFSCSSADCIAFGGGTEVVVK

SEQ ID NO: 303 - protein, 119 aa, Artificial Sequence
  VH
QSLEESGGRLVTPGGSLTLTCTVSGIDLSSYAMDWVRQAPGKGLEWIGVIGAGGSTYYASWANGRFTISKTSTTVDLKISSPTTEDTATYFCARDIGGDYSSRYYFSLWGPGTLVTVSS

SEQ ID NO: 304 - protein, 108 aa, Artificial Sequence
  VL
DIVMTQTPASVEAAVGGTVTIKCQASQSTSTALAWYQQKPGQRPKLLIYDSSKLASGVPSRFSGSGSGTEFTLTISGVQSDDAASYYCQQGYNINNVAFGGGTEVVVK

SEQ ID NO: 305 - protein, 112 aa, Artificial Sequence
  VH
QSLEESGGRLVTPGTPLTLTCTASGFTISSHHMTWVRQAPGEGLEWLGVIFPSGHTYYTSWAKGRFTISRTSTTVDLKMASLTIEDTATYFCVRDVGYFTLWGQGTLVTVSS

SEQ ID NO: 306 - protein, 110 aa, Artificial Sequence
  VL
AQVLTQTPSPVSAAVGGTVTISCQSSESVGGNNWLAWYQQKLGQPPKLLIYGASTLASGVPSRFSGSGSGTQFTLTISEVQSDDAATYYCQGYYSDVTNAFGGGTEVVVE

SEQ ID NO: 307 - protein, 118 aa, Artificial Sequence
  VH
QSVEESGGRLVTPGTPLTLTCTASGFSLSSYYMGWVRQAPGKGLEWIGFITSGGSGSTYYASWAKGRFTISKTSTTVDLKMTSLTTEDTATYFCARYGDSFYWALDLWGQGTLVTVSS

SEQ ID NO: 308 - protein, 109 aa, Artificial Sequence
  VL
AQVLTQTPSSVSAAVGGTVTINCQSSQSVLNNDLSWYQQKPGQPPKLLIYAASTLASGVPSRFKGSGSGTQFTLTINVGQSDDAATYYCQGYFIDVNNPFGGGTEVVVK

SEQ ID NO: 309 - protein, 117 aa, Artificial Sequence
  VH
QSLEESGGRLVTPGTPLTLTCTVSGIDLSRYDMSWVRQAPGKGLEWIGFIGASGSTYYASWVKGRFTISKTSTTVDLKITSPTTEDTATYFCAREETDSRGYYYSLWGPGTPVTVSS

SEQ ID NO: 310 - protein, 110 aa, Artificial Sequence
  VL
ALVMTQTPASVEAAVGGTVTINCQASQSISDLLGWYQQKPGQPPKLLIYDASDLASGVPSRFSGSGSGTEFTLTISGVQSDDAATYYCQQGYSINNVDNAFGGGTEVVVK

SEQ ID NO: 311 - protein, 118 aa, Artificial Sequence
  VH
QSVEESGGRLVTPGTPLTLTCTVSGFSLSSYGMIWVRQAPGKGLEWIAWSSSNDNTYYASWAKGRFTISKTSSTTVDLKMTSLTTEDTATYFCARNGVYSTGNYFDLWGQGTLVTVSS

SEQ ID NO: 312 - protein, 113 aa, Artificial Sequence
  VL
AQVLTQTPSPVSAAVGGTVTINCQASQSVYNNNNLAWYQQKPGQPPKFLIYAASRLPSGVPPRFSGSGSGTQFTLTISDVQSDDAATYYCQGEFDCDSADCFAFGGGTEVVVK

SEQ ID NO: 313 - protein, 121 aa, Artificial Sequence
  VH
QEQLEESGGDLVKPGASLTLTCTASGFSFSSNYCMCWVRQAPGKGLEWIACICAGASGATYYASWAKGRFTVSKTSSTTVTLQMTSLTGADTATYFCARYDNSGWGDFKLWGPGTLVTVSS

SEQ ID NO: 314 - protein, 111 aa, Artificial Sequence
  VL
DIVMTQTPASVSEPVGGTVTINCQASQNIGTYLAWYQQKPGQRPKLLIYAASYLASGVPSRFKGSGSGTEVALTISDLESADAATYYCQNTYYDSPVVGGAFGGGTEVVVK

SEQ ID NO: 315 - protein, 118 aa, Artificial Sequence
  VH
QSVEESGGRLVTPGGSLTLTCSVSGIDLSSYAMNWVRQAPGKGLEWIGIISTGGSTYYANWAKGRFTISKTSTTVDLKITSPTTEDTATYICARDVGGTTVPYYFDLWGPGTLVTVSS

SEQ ID NO: 316 - protein, 110 aa, Artificial Sequence
  VL
AYDMTQTPASMEVAVGGTVTIKCQASESISSWLAWYQQKPGQPPKPLIYEASRLASGVPSRFKGSGSGTEFTLTISGVESADAATYYCQQGYGSSDVHNIFGGGTEVVVK

SEQ ID NO: 317 - protein, 119 aa, Artificial Sequence
  VH
QSVEESGGRLVTPGTPLTLTCTASGFSLSNYHMSWVRQAPGKGLEWIGIIYAGSDSTWYASWAKGRFTISKTSTTVDLKITSPTTEDTATYFCARQPGGGASDTQLDLWGQGTLVTVSS

SEQ ID NO: 318 - protein, 111 aa, Artificial Sequence
  VL
AAVLTQTASPVSAAVGGTVTINCQSSQNIFDNNQLSWFQHKSGQSPKLLIYRASTLASGVPSRFKGSGSGTQFTLTISDVQSDDAATYYCLGGYSSSSDTVFGGGTEVVVK

SEQ ID NO: 319 - protein, 116 aa, Artificial Sequence
  VH
QSLEESGGRLVTPDESLTLTCTVSGFSLSSNAMIWVRQAPGKGLEWIGIIDTGGSAYYASWAKGRFTISKTSTTVDLKITSPTTEDTATYFCARDRYTDSSGYNLWGQGTLVTVSS

SEQ ID NO: 320 - protein, 112 aa, Artificial Sequence
  VL
DIVMTQTPASVEAAVGGTVTIKCQASQSIGASLAWYKQKPGQPPKLLIYSASWLASGVPSRFKGSGSGTEFTLTISDLASADAATYYCQSYYYRSSSGYGYAFGGGTEVVVK

SEQ ID NO: 321 - protein, 117 aa, Artificial Sequence
  VH
QSVEESGGRLVTPGTPLTLTCTVSGFSLSSYVMSWVRQAPGKGLEWIGYSDYGGTAYYANWAKGRFTISKTSTTVELKITSPTIEDTATYFCARGGYDGYLLVTGLWGPGTLVTVSS

SEQ ID NO: 322 - protein, 110 aa, Artificial Sequence
  VL
DIVMTQTPASVSEPVGGTVTIKCQASQSISSYLAWYQQKPGQPPKLLIYSASTLASGVSSRFKGSGSGTEYTLTISDLESADAATYYCQTYYGGGPFGNGFGGGTEVVVK

SEQ ID NO: 323 - protein, 115 aa, Artificial Sequence
  VH
QSVEESGGRLVKPDETLTLTCTVSGIDLTSYAMGWVRQAPGEGLEWIGAIGSGGGIYYASWARGRFTISKTSSTTVDLKIPSPTTEDTATYFCARVPQWAYLDLWGQGTLVTVSS

SEQ ID NO: 324 - protein, 110 aa, Artificial Sequence
  VL
AQVLTQTPASVSAAVGGTVTISCQSSESVYKNNYLSWYQQKPGQPPKLLIYDASTLASGVPSRFSGSGSGTQFTLTISGVQSEDAATYYCQGYYGGGIFTFGGGTEVVVK

SEQ ID NO: 325 - protein, 117 aa, Artificial Sequence
  VH
QSLEESGGRLVTPGTPLTLTCTVSGIDLSSYAMGWVRQAPGKGLEWIGTISTISNTYYASWANGRFTISKTSTTVDLKMTSLTASDTATYFCARGASNTINDYFNLWGQGTLVTVSS

SEQ ID NO: 326 - protein, 111 aa, Artificial Sequence
  VL
DIVMTQTPASVSEPVGGTVTIKCQASQSVGNYLAWYQQKPGQPPKLLIYDASNLASGVSSRFKGSGFATEFILTISDLESTDAATYYCHSYVYSSGNVYNGFGGGTEVVVK

SEQ ID NO: 327 - protein, 117 aa, Artificial Sequence
  VH
QSVEESGGRLVTPGTPLTLTCTVSGIDLSSNVMTWVRQAPGKGLEWIGYIYASATTYYATWAKGRFTISKTSTTVDLKMTSPTTEDTATYFCARERLASRGDYSDLWGQGTLVTVSS

SEQ ID NO: 328 - protein, 111 aa, Artificial Sequence
  VL
AYDMTQTPASVEAAVGGTVTIKCQASESIGDLLAWYQQKPGQPPKLLIYDASDLASGVPSRFKGSGSGTEFTLTISGVESADAATYYCQQGYTTTSNVDNIFGGGTEVVVK

SEQ ID NO: 329 - protein, 117 aa, Artificial Sequence
  VH
QSVEESGGRLVTPGTPLTLTCTVSGFSLSGYHMCWVRQAPGKGLQYIGIIGSNGNTYYASWAKSRSTITRNTNENTVTLKMTSLTTEDTATYFCARSSGWGARFNLWGQGTLVTVSS

SEQ ID NO: 330 - protein, 111 aa, Artificial Sequence
  VL
AQVLTQTPSSVSAAVGGTVTINCQASQSIYNDNELSWYQQKPGQPPKLLIYKASTLASGVPLRFSGSGSGTQFTLTISDVQSDVAATYYCLGGGMTPSDTTFGGGTEVVVK

SEQ ID NO: 331 - protein, 119 aa, Artificial Sequence
  VH
QSLEESGGRLVTPGTPLTLTCTASGFSLSSYYMSWVRQAPGKGLEWIGIIDRAGTTYYATWAKGRFTISRTSTTVDLKMTSPTTEDTGTYFCARNFIYGVGTYYGSDLWGQGTLVTVSS

SEQ ID NO: 332 - protein, 110 aa, Artificial Sequence
  VL
DVVMTQTPASVSDPVGGTVTIKCQASESISRRLAWYQQKPGQPPKLLIYGASDLASGVPSRFSGSGSGTEFTLTISGVQSDDAATYYCQDTDYGSGHLGAFGGGTEVVVK

SEQ ID NO: 333 - protein, 122 aa, Artificial Sequence
  VH
QSVEESGGRLVTPGGSLTLSCTVNGFSLSSHGVSWVRQAPGKGLEWIGIIYVISGHAYYASWAKGRFTISKTSTTVDLKIASPTTEDTATYFCARGNYGSDSGPNFTRLDLWGQGTLVTVSS

SEQ ID NO: 334 - protein, 113 aa, Artificial Sequence
  VL
AQVLTQTPSPVSATVGGTLTINCQASQSLYNNDYLAWYQQKPGQPPKLLIYLASTLASGVSSRFKGSGSGTQFTLTISGVQSDDAATYYCQGEFSCSSGDCLAFGGGTEVVVK

SEQ ID NO: 335 - protein, 113 aa, Artificial Sequence
  VH
QSLEESGGRLVTPGTPLTLTCTASGFSLSSYDMGWVRQAPGKGLEWIGIISSSGSTYYASWAKGRFTISKTSSTTVDLKMTSLTTEDTATYFCARTSLDGNLWGQGTLVTVSS

SEQ ID NO: 336 - protein, 110 aa, Artificial Sequence
  VL
AFEMTQTPSSVSEPVGGTVTIKCQASQSIYNYLSWYQQKPGQPPKLLIYDASALASGVPSRFKGSGSGTDFTLTISDLESADAATYYCQQDYSVSDVDNSFGGGTEVVVK

SEQ ID NO: 337 - protein, 117 aa, Artificial Sequence
  VH
QSVEESGGRLVTPGTPLTLTCTVSGFSLSSSHMCWVRQAPGKGLEWIGVINIGDIAYYASWAKGRFTISKTSTTVDLKMTSLTAADTATYFCARENAYGTGWDFDLWGQGTLVTVSS

SEQ ID NO: 338 - protein, 110 aa, Artificial Sequence
  VL
AYDMTQTPASVEVAVGGTVTIKCQASESIRNALAWYQQKPGQPPKQLIYSASTLASGVPSRFKGSGSGTEFTLTISGVQSDDAATYYCQQGFSLRNVDNAFGGGTEVVVK

SEQ ID NO: 339 - protein, 120 aa, Artificial Sequence
  VH
QSVEESGGRLVTPGTPLTLTCTLSGFSLSNYAMSWVRQAPGKGLEWIGVIYTSGTTHYASWAKGRFTISKTSTTVDLRMTSLTTEDTATYFCARSRYYGSGWGGYYFNLWGQGTLVTVSS

SEQ ID NO: 340 - protein, 111 aa, Artificial Sequence
  VL
DVVMTQTPSPVSAAVGGTVTINCQASEDIYSLLAWYQQKPGQRPKLLIYGASNLESGVPSRFKGSGSGTEYTLTISGVQSADAATYYCHGGTYTGSADINAFGGGTEVVVE

SEQ ID NO: 341 - protein, 117 aa, Artificial Sequence
  VH
QSVEESGGRLVTPGTPLTLTCTVSGIDLSNYAMSWVRQTPGKGLEWIGAIGIGGNTYYASWAKGRFTISRTSTMVDLKVASPTPEDTATYFCARHAGAGVVNWLDLWGQGTLVTVSS

SEQ ID NO: 342 - protein, 111 aa, Artificial Sequence
  VL
DVVMTQTPASVSEPVGGTVTIKCQASQSIGSNLAWYQQKPGQPPKLLIYAASDLASGVPSRFSGSGSGTEFTLTISGVQSDDAATFYCQTYGSGSFSSFNLFGGGTEVVVK

SEQ ID NO: 343 - protein, 116 aa, Artificial Sequence
  VH
QSVEESGGRLVTPGTPLTLTCTVSGFSLSSYYMIWVRQAPGKGLEWIGIINTSGGAYYATWANGRFTISRTSTTVDLKITSPTTEDTATYFCARYLDNGFYCPDLWGQGTLVIVSS

SEQ ID NO: 344 - protein, 110 aa, Artificial Sequence
  VL
DIVMTQTPSSVSEAVGGTVTIKCQASEDIYTLLAWYQQKPGQPPKLLIYKASILASGVSSRFKGGGSGADFTLTISDLESADAATYYCQSTYYGAAYIGAFGGGTEVVVK

SEQ ID NO: 345 - protein, 118 aa, Artificial Sequence
  VH
QSVEETGGRLVTPGTPLTLTCAASGVSLSGYYAMSWVRQAPGKGLEWIGYLDATGSTYYASWVKGRFIISRPSTTVDLQITSPTIEDTATYFCARGSYDGVGYNWGLWGQGTLVTVSS

SEQ ID NO: 346 - protein, 111 aa, Artificial Sequence
  VL
DIVMTQTPASVSEPVGGTVTIKCQASESIYNGLAWYQQKPGQPPKRLIYGASTLTSGVPSRFKGSGSGTEFTLTISDLESDDAATYYCQSNYGSGSRSNYIFGGGTEVVVK

SEQ ID NO: 347 - protein, 116 aa, Artificial Sequence
  VH
QSLEESGGRLVTPGTPLTLTCTVSGIDLNNNAMTWVRQAPGEGLEWIGIISTADTTTYASWTKGRFTISKTSTTVDLKITSPTTEDTATYFCARAAYFSYGYFNLWGQGTLVTVSS

SEQ ID NO: 348 - protein, 108 aa, Artificial Sequence
  VL
DIVMTQTPASVEAAVGGTVTIKCQASQNIGNALAWYQQKPGQPPKLLIYGASTLASGVPSRFKGSGSGTEFTLTISDLESADATTYFCQSYVYSDGNVFGGGTEVVVK

SEQ ID NO: 349 - protein, 123 aa, Artificial Sequence
  VH
QEQLVESGGGLVQPEGSLTLTCTATGIDFSTNYRSCWVRQAPGKGLEWIACIDTDDSDSTYYASWAKGRFTISKTSSTTVTLQMTSLTAADTATYFCTRAYTTSDYAWSFYLWGPGTLVTVSS

SEQ ID NO: 350 - protein, 111 aa, Artificial Sequence
  VL
DLVMTQTPASVEAAVGGTVTIKCQTSQSISKFLNWYQQTPGQPPKLLIYRASTLESGVPSRFEGSGSGTEFTLTISDLESADAATYYCQCTYGGTSGSVWAFGGGTEVVVK

SEQ ID NO: 351 - protein, 123 aa, Artificial Sequence
  VH
QEQLEESGGDLVKPEGSLTLTCTASGFSFSSSFYMCWVRQAPGKGLEWVACIYAEDSDYTYYASWAKGRFTISKTSSTTVTLQMTSLTAADTATYFCAREILYPTNTDSFDLWGPGTLVTVSS

SEQ ID NO: 352 - protein, 110 aa, Artificial Sequence
  VL
AFELTQTPSSVEAAVGGTVTIKCQASESFSSRLAWYQQKPGQPPKLLIYRASTLASGVPSRFKGSGSGTDFTLTISDLESADAAAYYCQAYVGISSGGYAFGGGTEVVVG

SEQ ID NO: 353 - protein, 121 aa, Artificial Sequence
  VH
QSLEESGGDLVKPGASLTLTCTASGFSFSSSYWICWVRQAPGKGLEWVACISAPGSGSTFDASWAKGRFTISKTSSTTVTLQMTSLTAADTATYFCARFYAGGSGDYFDLWGPGTLVTVSS

SEQ ID NO: 354 - protein, 110 aa, Artificial Sequence
  VL
QIVMTQTPSSTSEPVGGTVSIKCQASQNIGSYLAWYQQKPGQPPKVLIYTTSDLASGVPSRFKGSGSGTQFTLTISDLESDDAATYYCLGVYGYSSDDVAFGGGTEVVVK

SEQ ID NO: 355 - protein, 121 aa, Artificial Sequence
  VH
QSLEESGGRLVTPGTPLTLTCTVSGIDLSDYAMAWVRQAPGKGLEYIGFINIGGISSVANWAIGRFTISKSSTTVDLKITSPTTEDTATYFCAREGYTTGGGGPYYGMDLWGPGTLVTVSS

SEQ ID NO: 356 - protein, 110 aa, Artificial Sequence
  VL
DIVMTQTPASVSEPMGGTVTIKCQASQSIHSWLSWYQQKPGQPPKRLIYTASTLASGVPSRFKGSGSGTEYTLTISDLESADAATYYCQRNSYSDFNNYVFGGGTEVVVK

SEQ ID NO: 357 - protein, 124 aa, Artificial Sequence
  VH
QSLEESGGGLVQPEGSLTLTCTASGFSFSSSDYMCWVRQAPGKGLEWIACMYTGSVEHTYYANWAEGRFTISKTSSTTVTLQMTSLTAADTATYFCARSPTGYPDYGYGGFSLWGPGTLVTVSS

SEQ ID NO: 358 - protein, 110 aa, Artificial Sequence
  VL
ALVMTQTPSSVSAAVGGTVTINCQASQNIYSNLAWYQQKSGQRPKLLIHGASNLESGVPSRFKGSGSGTEFTLTISDLESADAATYYCQSAYYSGGPDMAFGGGTEVVVK

SEQ ID NO: 359 - protein, 117 aa, Artificial Sequence
  VH
QSVEESGGRLVTPGTPLTLTCTASGFYLSSHYMSWVRQAPGKGLEWIGIIYATGIASYANWAKGRFTISKTSTTVSLKMTSPTTEDTATYFCARYDSQDYYGYGNLWGPGTLVTVSS

SEQ ID NO: 360 - protein, 110 aa, Artificial Sequence
  VL
AYDMTQTPASVEVAVGGTVTIKCQASQNIYNNLAWYQQKPGQRPKLLIYRASTLASGVSSQFKGSGSGTEYTLTISGVESADAATYYCQQGYSVHDVYNTFGGGTEVVVK

SEQ ID NO: 361 - protein, 117 aa, Artificial Sequence
  VH
QSVEESGGRLVTPGTPLTLTCTVSGFSLSGYHMCWVRQAPGKGLQYIGIIGSNGVTYYASWAKSRSTITRNTNENTVTLKMTSLTTEDTATYFCARSSGWGARFNLWGQGTLVTVSS

SEQ ID NO: 362 - protein, 111 aa, Artificial Sequence
  VL
AQVLTQTPASVSAAVGGTVTINCQASQSVYNDNELSWYQQKPGQPPKLLIYKASTLTSGVPLRFSGSGSGTQFTLTISDVQSDDAATYYCLGGGSTPSDSTFGGGTEVVVK

SEQ ID NO: 363 - protein, 117 aa, Artificial Sequence
  VH
QSVEESGGRLVTPGTPLTLTCTVSGFTISSYHMCWVRQAPGKGLQYIGIIGSNGNTYYASWAKSRSTITRNTNENTVTLKMTSLTTEDTATYFCARSSGWGARFNLWGQGTLVTVSS

SEQ ID NO: 364 - protein, 111 aa, Artificial Sequence
  VL
AQVLTQTPSSVSAAVGGTVTINCQASQSVYNDNELSWYQQKPGQPPKLLIYKASTLTSGVPLRFSGSGSGTQFTLTISDVQSDDAATYYCLGGGSTPSDSTFGGGTEVVVK

SEQ ID NO: 365 - protein, 115 aa, Artificial Sequence
  VH
QSVEESGGRLVTPGTPLTLTCTVSGFSLNNAHMCWVRQAPGKGLEWIGIIGASGSTYYASWAKGRFTISKTSTTVDLKMTSLTTEDTATYFCGRTDVGYTTANLWGQGTLVTVSS

SEQ ID NO: 366 - protein, 111 aa, Artificial Sequence
  VL
DVVMTQTPASVSAAVGGTVTIKCQASQTISSYLSWYQQKPGQPPKRLIYSASTLASGVSSRFKGSGSGTQFTLTISDLESADAATYYCQAYDTTSGTDLWAFGGGTEVVVK

SEQ ID NO: 367 - protein, 119 aa, Artificial Sequence
  VH
QEQLEESGGDLVKPGASLTLTCTASGFSFSSDYDMCWVSQAPGKGLEWIACIIGGSSDSTWYASWAKGRFTISKTSSTTVTLQVTGLTAADTATYFCARNVGFSYYDLWGPGTLVTVSS

SEQ ID NO: 368 - protein, 113 aa, Artificial Sequence
  VL
AQVLTQTPSPVSAAVGGTVTINCQASQSLYNNKNLAWYQQKPGQPPKLLIYYASTLASGVSSRFKGSGSGTQFTLTISGVQSDDAATYYCQGEFSCSSGDCFAFGGGTEVVVK

SEQ ID NO: 369 - protein, 117 aa, Artificial Sequence
  VH
QSLEESGGRLVTPGGSLTLTCTVSGIDLSSYAMGWFRQAPGKGLEYIGIIYSSGSTWFANWVKGRFTISKTSTTVDLKMTSLTTEDTATYFCARYSAADHGDKFKLWGQGTLVTVSS

SEQ ID NO: 370 - protein, 111 aa, Artificial Sequence
  VL
AAVLTQTPSPVSAAVGGTVSISCQSSKNIFDNTRLSWFQQKPGQPPKQLIYGASTLASGVPSRFSGSGSGTQFTLTISGVQSDDAATYYCLGEYSSDSDTSFGGGTEVVVK

SEQ ID NO: 371 - protein, 120 aa, Artificial Sequence
  VH
QSLEESGGRLVTPGTPLTLTCTASGFSLSTYYMSWVRQAPGKGLEWIGIIYTSGSTYYASWAKGRFTISRNSTTVDLKITSPTTEDTATYFCARSRVPGDTTGLYYFNLWGPGTLVTVSS

SEQ ID NO: 372 - protein, 111 aa, Artificial Sequence
  VL
ALVMTQTPASVSAAVEGTVTINCQASENIYSNLAWYQQKPGQPPKLLIYHTSNLASGVPSRFKGSGAGTEFTLTISDLESDDAATYYCQSAYDSSSSDTFTFGGGTEVVVK

SEQ ID NO: 373 - protein, 8 aa, Artificial Sequence
  HCDR1
GFSLSRYW

SEQ ID NO: 374 - protein, 7 aa, Artificial Sequence
  HCDR2
IDNGDTA

SEQ ID NO: 375 - protein, 12 aa, Artificial Sequence
  HCDR3
TREGADHSGQDL

SEQ ID NO: 376 - protein, 8 aa, Artificial Sequence
  LCDR1
QSVISNND

SEQ ID NO: 377 - protein, 3 aa, Artificial Sequence
  LCDR2
RAS

SEQ ID NO: 378 - protein, 12 aa, Artificial Sequence
  LCDR3
QGGYAGIVDRRP

SEQ ID NO: 379 - protein, 9 aa, Artificial Sequence
  HCDR1
GFSFSATYW

SEQ ID NO: 380 - protein, 9 aa, Artificial Sequence
  HCDR2
IFGRSSSDT

SEQ ID NO: 381 - protein, 15 aa, Artificial Sequence
  HCDR3
ARGDSGHPYYYSFNL

SEQ ID NO: 382 - protein, 6 aa, Artificial Sequence
  LCDR1
QSIGGY

SEQ ID NO: 383 - protein, 3 aa, Artificial Sequence
  LCDR2
GAS

SEQ ID NO: 384 - protein, 11 aa, Artificial Sequence
  LCDR3
QCTHGTRSDWA

SEQ ID NO: 385 - protein, 8 aa, Artificial Sequence
  HCDR1
GIDLSTYA

SEQ ID NO: 386 - protein, 7 aa, Artificial Sequence
  HCDR2
IYGSGYT

SEQ ID NO: 387 - protein, 16 aa, Artificial Sequence
  HCDR3
ASGYGISSGNFLHFNL

SEQ ID NO: 388 - protein, 6 aa, Artificial Sequence
  LCDR1
ESIYFN

SEQ ID NO: 389 - protein, 3 aa, Artificial Sequence
  LCDR2
RAS

SEQ ID NO: 390 - protein, 12 aa, Artificial Sequence
  LCDR3
QQGYDSSHIDNA

SEQ ID NO: 391 - protein, 8 aa, Artificial Sequence
  HCDR1
GFSLSSNA

SEQ ID NO: 392 - protein, 7 aa, Artificial Sequence
  HCDR2
IYTHGSS

SEQ ID NO: 393 - protein, 9 aa, Artificial Sequence
  HCDR3
AGWAGGLSL

SEQ ID NO: 394 - protein, 6 aa, Artificial Sequence
  LCDR1
EDIDNA

SEQ ID NO: 395 - protein, 3 aa, Artificial Sequence
  LCDR2
SAS

SEQ ID NO: 396 - protein, 11 aa, Artificial Sequence
  LCDR3
QSAYGGTYGDG

SEQ ID NO: 397 - protein, 8 aa, Artificial Sequence
  HCDR1
GFSLSSYD

SEQ ID NO: 398 - protein, 7 aa, Artificial Sequence
  HCDR2
IWSDGNT

SEQ ID NO: 399 - protein, 9 aa, Artificial Sequence
  HCDR3
ARGYTGFFL

SEQ ID NO: 400 - protein, 7 aa, Artificial Sequence
  LCDR1
QSIGSSY

SEQ ID NO: 401 - protein, 3 aa, Artificial Sequence
  LCDR2
KTS

SEQ ID NO: 402 - protein, 12 aa, Artificial Sequence
  LCDR3
QCTYYGGSWRVA

SEQ ID NO: 403 - protein, 8 aa, Artificial Sequence
  HCDR1
GFSLSSYD

SEQ ID NO: 404 - protein, 7 aa, Artificial Sequence
  HCDR2
IWSDGNT

SEQ ID NO: 405 - protein, 9 aa, Artificial Sequence
  HCDR3
ARGYTGFFL

SEQ ID NO: 406 - protein, 7 aa, Artificial Sequence
  LCDR1
QSIGSSY

SEQ ID NO: 407 - protein, 3 aa, Artificial Sequence
  LCDR2
KTS

SEQ ID NO: 408 - protein, 12 aa, Artificial Sequence
  LCDR3
QCTYYGSSWRVA

SEQ ID NO: 409 - protein, 8 aa, Artificial Sequence
  HCDR1
GLDFISSY

SEQ ID NO: 410 - protein, 8 aa, Artificial Sequence
  HCDR2
IAPGGGNT

SEQ ID NO: 411 - protein, 12 aa, Artificial Sequence
  HCDR3
ARTYPSIWYFGL

SEQ ID NO: 412 - protein, 6 aa, Artificial Sequence
  LCDR1
QSIGSN

SEQ ID NO: 413 - protein, 3 aa, Artificial Sequence
  LCDR2
GAS

SEQ ID NO: 414 - protein, 9 aa, Artificial Sequence
  LCDR3
QSFYAASSA

SEQ ID NO: 415 - protein, 8 aa, Artificial Sequence
  HCDR1
GSDISTYH

SEQ ID NO: 416 - protein, 7 aa, Artificial Sequence
  HCDR2
INTGGTT

SEQ ID NO: 417 - protein, 12 aa, Artificial Sequence
  HCDR3
ARYDAGHAFFDL

SEQ ID NO: 418 - protein, 7 aa, Artificial Sequence
  LCDR1
QSIGSSY

SEQ ID NO: 419 - protein, 3 aa, Artificial Sequence
  LCDR2
SAS

SEQ ID NO: 420 - protein, 13 aa, Artificial Sequence
  LCDR3
QGYDGDTTTAFFA

SEQ ID NO: 421 - protein, 9 aa, Artificial Sequence
  HCDR1
GFSFSSRYY

SEQ ID NO: 422 - protein, 8 aa, Artificial Sequence
  HCDR2
IDTSSGST

SEQ ID NO: 423 - protein, 13 aa, Artificial Sequence
  HCDR3
ARDLYHENSDGDW

SEQ ID NO: 424 - protein, 6 aa, Artificial Sequence
  LCDR1
ESINNY

SEQ ID NO: 425 - protein, 3 aa, Artificial Sequence
  LCDR2
KAS

SEQ ID NO: 426 - protein, 13 aa, Artificial Sequence
  LCDR3
QSYYGASGSGSNV

SEQ ID NO: 427 - protein, 8 aa, Artificial Sequence
  HCDR1
GIDLNNYV

SEQ ID NO: 428 - protein, 7 aa, Artificial Sequence
  HCDR2
INTAGST

SEQ ID NO: 429 - protein, 14 aa, Artificial Sequence
  HCDR3
ARDSSYYIGYYFNL

SEQ ID NO: 430 - protein, 6 aa, Artificial Sequence
  LCDR1
QSIGSN

SEQ ID NO: 431 - protein, 3 aa, Artificial Sequence
  LCDR2
DAS

SEQ ID NO: 432 - protein, 13 aa, Artificial Sequence
  LCDR3
QQGYSATTNVDNA

SEQ ID NO: 433 - protein, 8 aa, Artificial Sequence
  HCDR1
GFSLSKYD

SEQ ID NO: 434 - protein, 7 aa, Artificial Sequence
  HCDR2
IGASDST

SEQ ID NO: 435 - protein, 14 aa, Artificial Sequence
  HCDR3
AREYPDARGYYYNL

SEQ ID NO: 436 - protein, 6 aa, Artificial Sequence
  LCDR1
QSISDL

SEQ ID NO: 437 - protein, 3 aa, Artificial Sequence
  LCDR2
DAS

SEQ ID NO: 438 - protein, 12 aa, Artificial Sequence
  LCDR3
QQGYSITNVDNV

SEQ ID NO: 439 - protein, 8 aa, Artificial Sequence
  HCDR1
GFSLSNYD

SEQ ID NO: 440 - protein, 7 aa, Artificial Sequence
  HCDR2
IWSDGNT

SEQ ID NO: 441 - protein, 9 aa, Artificial Sequence
  HCDR3
ARGYTGFFL

SEQ ID NO: 442 - protein, 7 aa, Artificial Sequence
  LCDR1
QSIGSSY

SEQ ID NO: 443 - protein, 3 aa, Artificial Sequence
  LCDR2
KTS

SEQ ID NO: 444 - protein, 12 aa, Artificial Sequence
  LCDR3
QCTYYGGSWRVA

SEQ ID NO: 445 - protein, 8 aa, Artificial Sequence
  HCDR1
GFSLSSYY

SEQ ID NO: 446 - protein, 7 aa, Artificial Sequence
  HCDR2
IYTGGSA

SEQ ID NO: 447 - protein, 14 aa, Artificial Sequence
  HCDR3
ARDAGDRIYTTFNL

SEQ ID NO: 448 - protein, 6 aa, Artificial Sequence
  LCDR1
QSIGSD

SEQ ID NO: 449 - protein, 3 aa, Artificial Sequence
  LCDR2
RAS

SEQ ID NO: 450 - protein, 13 aa, Artificial Sequence
  LCDR3
LGIDSYSSDDGIA

SEQ ID NO: 451 - protein, 8 aa, Artificial Sequence
  HCDR1
GFSLSNYY

SEQ ID NO: 452 - protein, 7 aa, Artificial Sequence
  HCDR2
ISTYGDT

SEQ ID NO: 453 - protein, 14 aa, Artificial Sequence
  HCDR3
ARGSSDTYYTYFNL

SEQ ID NO: 454 - protein, 6 aa, Artificial Sequence
  LCDR1
QKIYNN

SEQ ID NO: 455 - protein, 3 aa, Artificial Sequence
  LCDR2
SAS

SEQ ID NO: 456 - protein, 15 aa, Artificial Sequence
  LCDR3
QSYGVSANTISYGLP

SEQ ID NO: 457 - protein, 8 aa, Artificial Sequence
  HCDR1
GFSLSSYA

SEQ ID NO: 458 - protein, 7 aa, Artificial Sequence
  HCDR2
LYRNDAA

SEQ ID NO: 459 - protein, 12 aa, Artificial Sequence
  HCDR3
VRGYVNDGYYNL

SEQ ID NO: 460 - protein, 6 aa, Artificial Sequence
  LCDR1
ESIGYR

SEQ ID NO: 461 - protein, 3 aa, Artificial Sequence
  LCDR2
DAS

SEQ ID NO: 462 - protein, 12 aa, Artificial Sequence
  LCDR3
QQDYSYSIIDNS

SEQ ID NO: 463 - protein, 8 aa, Artificial Sequence
  HCDR1
GSDISNYG

SEQ ID NO: 464 - protein, 8 aa, Artificial Sequence
  HCDR2
INADGGGT

SEQ ID NO: 465 - protein, 11 aa, Artificial Sequence
  HCDR3
ATYGGGGGHNL

SEQ ID NO: 466 - protein, 8 aa, Artificial Sequence
  LCDR1
QSVYDNNA

SEQ ID NO: 467 - protein, 3 aa, Artificial Sequence
  LCDR2
SAS

SEQ ID NO: 468 - protein, 11 aa, Artificial Sequence
  LCDR3
AAYYGSGDIFA

SEQ ID NO: 469 - protein, 9 aa, Artificial Sequence
  HCDR1
GFSFSSRYY

SEQ ID NO: 470 - protein, 9 aa, Artificial Sequence
  HCDR2
IAPDVSGSA

SEQ ID NO: 471 - protein, 13 aa, Artificial Sequence
  HCDR3
ARSVPGSLFYFQL

SEQ ID NO: 472 - protein, 8 aa, Artificial Sequence
  LCDR1
QSVYNKNE

SEQ ID NO: 473 - protein, 3 aa, Artificial Sequence
  LCDR2
DAS

SEQ ID NO: 474 - protein, 12 aa, Artificial Sequence
  LCDR3
QGSYYSSGSYTA

SEQ ID NO: 475 - protein, 9 aa, Artificial Sequence
  HCDR1
GIDFSSSYY

SEQ ID NO: 476 - protein, 8 aa, Artificial Sequence
  HCDR2
IATGGGNT

SEQ ID NO: 477 - protein, 12 aa, Artificial Sequence
  HCDR3
ARTYPSMWYFNL

SEQ ID NO: 478 - protein, 6 aa, Artificial Sequence
  LCDR1
QSIGFN

SEQ ID NO: 479 - protein, 3 aa, Artificial Sequence
  LCDR2
GVS

SEQ ID NO: 480 - protein, 9 aa, Artificial Sequence
  LCDR3
QSFYAGSSA

SEQ ID NO: 481 - protein, 9 aa, Artificial Sequence
  HCDR1
GFSFSSGYY

SEQ ID NO: 482 - protein, 9 aa, Artificial Sequence
  HCDR2
IFAGSGGGA

SEQ ID NO: 483 - protein, 13 aa, Artificial Sequence
  HCDR3
ARPLSGYAYGMDL

SEQ ID NO: 484 - protein, 6 aa, Artificial Sequence
  LCDR1
QTISNY

SEQ ID NO: 485 - protein, 3 aa, Artificial Sequence
  LCDR2
GAS

SEQ ID NO: 486 - protein, 13 aa, Artificial Sequence
  LCDR3
QCTYDGSSDVGGA

SEQ ID NO: 487 - protein, 9 aa, Artificial Sequence
  HCDR1
GFSFSSSYW

SEQ ID NO: 488 - protein, 8 aa, Artificial Sequence
  HCDR2
IITGRGNT

SEQ ID NO: 489 - protein, 12 aa, Artificial Sequence
  HCDR3
ARGPGGADPVNL

SEQ ID NO: 490 - protein, 6 aa, Artificial Sequence
  LCDR1
QSIYSN

SEQ ID NO: 491 - protein, 3 aa, Artificial Sequence
  LCDR2
RAS

SEQ ID NO: 492 - protein, 13 aa, Artificial Sequence
  LCDR3
QCTYDGSSYVPNA

SEQ ID NO: 493 - protein, 8 aa, Artificial Sequence
  HCDR1
GFSLSSYD

SEQ ID NO: 494 - protein, 7 aa, Artificial Sequence
  HCDR2
IWSDGNT

SEQ ID NO: 495 - protein, 9 aa, Artificial Sequence
  HCDR3
ARGYTGFFL

SEQ ID NO: 496 - protein, 7 aa, Artificial Sequence
  LCDR1
QSIGSSY

SEQ ID NO: 497 - protein, 3 aa, Artificial Sequence
  LCDR2
KTS

SEQ ID NO: 498 - protein, 12 aa, Artificial Sequence
  LCDR3
QCTYYGGSWRVA

SEQ ID NO: 499 - protein, 8 aa, Artificial Sequence
  HCDR1
GFSLSSYS

SEQ ID NO: 500 - protein, 7 aa, Artificial Sequence
  HCDR2
VYASGST

SEQ ID NO: 501 - protein, 11 aa, Artificial Sequence
  HCDR3
ARGDVLYAFDP

SEQ ID NO: 502 - protein, 6 aa, Artificial Sequence
  LCDR1
ENIYSY

SEQ ID NO: 503 - protein, 3 aa, Artificial Sequence
  LCDR2
YAS

SEQ ID NO: 504 - protein, 11 aa, Artificial Sequence
  LCDR3
QYTYSTSPGYI

SEQ ID NO: 505 - protein, 9 aa, Artificial Sequence
  HCDR1
GVSFSNNYY

SEQ ID NO: 506 - protein, 9 aa, Artificial Sequence
  HCDR2
VYTGDDDYT

SEQ ID NO: 507 - protein, 15 aa, Artificial Sequence
  HCDR3
AREILYPADTDSFDL

SEQ ID NO: 508 - protein, 6 aa, Artificial Sequence
  LCDR1
ESISSR

SEQ ID NO: 509 - protein, 3 aa, Artificial Sequence
  LCDR2
RAS

SEQ ID NO: 510 - protein, 12 aa, Artificial Sequence
  LCDR3
QAYVGISSGGYI

SEQ ID NO: 511 - protein, 8 aa, Artificial Sequence
  HCDR1
GIDLSRYA

SEQ ID NO: 512 - protein, 7 aa, Artificial Sequence
  HCDR2
ISVGGGT

SEQ ID NO: 513 - protein, 15 aa, Artificial Sequence
  HCDR3
ARSPYASTSASAFNL

SEQ ID NO: 514 - protein, 6 aa, Artificial Sequence
  LCDR1
QSIYSY

SEQ ID NO: 515 - protein, 3 aa, Artificial Sequence
  LCDR2
EAS

SEQ ID NO: 516 - protein, 10 aa, Artificial Sequence
  LCDR3
QSYSNTNTNT

SEQ ID NO: 517 - protein, 8 aa, Artificial Sequence
  HCDR1
GFSLSSYH

SEQ ID NO: 518 - protein, 8 aa, Artificial Sequence
  HCDR2
IYAGSGNT

SEQ ID NO: 519 - protein, 15 aa, Artificial Sequence
  HCDR3
ARQPGGDASDTQLDL

SEQ ID NO: 520 - protein, 8 aa, Artificial Sequence
  LCDR1
QSVFDHNQ

SEQ ID NO: 521 - protein, 3 aa, Artificial Sequence
  LCDR2
RAS

SEQ ID NO: 522 - protein, 11 aa, Artificial Sequence
  LCDR3
LGGYSSSSDTV

SEQ ID NO: 523 - protein, 8 aa, Artificial Sequence
  HCDR1
GFSLSRYD

SEQ ID NO: 524 - protein, 7 aa, Artificial Sequence
  HCDR2
IWSDGDT

SEQ ID NO: 525 - protein, 9 aa, Artificial Sequence
  HCDR3
ARGYTAWSL

SEQ ID NO: 526 - protein, 8 aa, Artificial Sequence
  LCDR1
ESVVGNNA

SEQ ID NO: 527 - protein, 3 aa, Artificial Sequence
  LCDR2
QAS

SEQ ID NO: 528 - protein, 12 aa, Artificial Sequence
  LCDR3
QGTYYSSGWYFA

SEQ ID NO: 529 - protein, 8 aa, Artificial Sequence
  HCDR1
GIDLSRYA

SEQ ID NO: 530 - protein, 7 aa, Artificial Sequence
  HCDR2
ISSSGST

SEQ ID NO: 531 - protein, 15 aa, Artificial Sequence
  HCDR3
ARSPYASTSASAFNL

SEQ ID NO: 532 - protein, 6 aa, Artificial Sequence
  LCDR1
QSISSW

SEQ ID NO: 533 - protein, 3 aa, Artificial Sequence
  LCDR2
EAS

SEQ ID NO: 534 - protein, 10 aa, Artificial Sequence
  LCDR3
QSYSSTTTNT

SEQ ID NO: 535 - protein, 8 aa, Artificial Sequence
  HCDR1
GIDLSTYA

SEQ ID NO: 536 - protein, 7 aa, Artificial Sequence
  HCDR2
ISTGGSA

SEQ ID NO: 537 - protein, 15 aa, Artificial Sequence
  HCDR3
ARLRDPYSYRTYFNL

SEQ ID NO: 538 - protein, 6 aa, Artificial Sequence
  LCDR1
LSISSA

SEQ ID NO: 539 - protein, 3 aa, Artificial Sequence
  LCDR2
DAS

SEQ ID NO: 540 - protein, 11 aa, Artificial Sequence
  LCDR3
QGPYDTVNNNS

SEQ ID NO: 541 - protein, 8 aa, Artificial Sequence
  HCDR1
GMDLSSYS

SEQ ID NO: 542 - protein, 7 aa, Artificial Sequence
  HCDR2
IGSSGGT

SEQ ID NO: 543 - protein, 13 aa, Artificial Sequence
  HCDR3
ARMLAGVYTRLDL

SEQ ID NO: 544 - protein, 7 aa, Artificial Sequence
  LCDR1
QSISSSY

SEQ ID NO: 545 - protein, 3 aa, Artificial Sequence
  LCDR2
KAS

SEQ ID NO: 546 - protein, 11 aa, Artificial Sequence
  LCDR3
AGDFIASSGNA

SEQ ID NO: 547 - protein, 7 aa, Artificial Sequence
  HCDR1
FSLSSTY

SEQ ID NO: 548 - protein, 7 aa, Artificial Sequence
  HCDR2
IYTDGST

SEQ ID NO: 549 - protein, 10 aa, Artificial Sequence
  HCDR3
ARGAAAAYDL

SEQ ID NO: 550 - protein, 6 aa, Artificial Sequence
  LCDR1
QNIYTN

SEQ ID NO: 551 - protein, 3 aa, Artificial Sequence
  LCDR2
GVS

SEQ ID NO: 552 - protein, 12 aa, Artificial Sequence
  LCDR3
QQGYSSTNVENA

SEQ ID NO: 553 - protein, 9 aa, Artificial Sequence
  HCDR1
GFDFSSSYY

SEQ ID NO: 554 - protein, 8 aa, Artificial Sequence
  HCDR2
IDTADGYT

SEQ ID NO: 555 - protein, 14 aa, Artificial Sequence
  HCDR3
ARERIAYNTDYFNL

SEQ ID NO: 556 - protein, 8 aa, Artificial Sequence
  LCDR1
QSLYNYNN

SEQ ID NO: 557 - protein, 3 aa, Artificial Sequence
  LCDR2
SVS

SEQ ID NO: 558 - protein, 10 aa, Artificial Sequence
  LCDR3
QGYYSGAVYT

SEQ ID NO: 559 - protein, 9 aa, Artificial Sequence
  HCDR1
GIDFSSNYY

SEQ ID NO: 560 - protein, 9 aa, Artificial Sequence
  HCDR2
IYTGSDDAA

SEQ ID NO: 561 - protein, 15 aa, Artificial Sequence
  HCDR3
AREILYPTNTDSFDL

SEQ ID NO: 562 - protein, 6 aa, Artificial Sequence
  LCDR1
ESISSR

SEQ ID NO: 563 - protein, 3 aa, Artificial Sequence
  LCDR2
RAA

SEQ ID NO: 564 - protein, 12 aa, Artificial Sequence
  LCDR3
QSYVGASSGGYF

SEQ ID NO: 565 - protein, 8 aa, Artificial Sequence
  HCDR1
ALSFYSAW

SEQ ID NO: 566 - protein, 9 aa, Artificial Sequence
  HCDR2
IYAGGSRST

SEQ ID NO: 567 - protein, 12 aa, Artificial Sequence
  HCDR3
ARSLSADTYWNL

SEQ ID NO: 568 - protein, 6 aa, Artificial Sequence
  LCDR1
ESISSW

SEQ ID NO: 569 - protein, 3 aa, Artificial Sequence
  LCDR2
RAS

SEQ ID NO: 570 - protein, 11 aa, Artificial Sequence
  LCDR3
QNNGGGTSGYT

SEQ ID NO: 571 - protein, 8 aa, Artificial Sequence
  HCDR1
GFSLSNYS

SEQ ID NO: 572 - protein, 7 aa, Artificial Sequence
  HCDR2
INMYGST

SEQ ID NO: 573 - protein, 15 aa, Artificial Sequence
  HCDR3
ARDAGGSTVPWYFDL

SEQ ID NO: 574 - protein, 6 aa, Artificial Sequence
  LCDR1
ESISDY

SEQ ID NO: 575 - protein, 3 aa, Artificial Sequence
  LCDR2
DAS

SEQ ID NO: 576 - protein, 12 aa, Artificial Sequence
  LCDR3
QQGYADSNVDNV

SEQ ID NO: 577 - protein, 9 aa, Artificial Sequence
  HCDR1
GFSFSSSYY

SEQ ID NO: 578 - protein, 8 aa, Artificial Sequence
  HCDR2
IDTVDNYT

SEQ ID NO: 579 - protein, 14 aa, Artificial Sequence
  HCDR3
ARERIAYNTDYFNL

SEQ ID NO: 580 - protein, 8 aa, Artificial Sequence
  LCDR1
QSLYNYNN

SEQ ID NO: 581 - protein, 3 aa, Artificial Sequence
  LCDR2
SAS

SEQ ID NO: 582 - protein, 10 aa, Artificial Sequence
  LCDR3
QGYYSGAVYT

SEQ ID NO: 583 - protein, 8 aa, Artificial Sequence
  HCDR1
GFSLSSYV

SEQ ID NO: 584 - protein, 7 aa, Artificial Sequence
  HCDR2
IDYGGTP

SEQ ID NO: 585 - protein, 14 aa, Artificial Sequence
  HCDR3
ARGGYGGYILVTGL

SEQ ID NO: 586 - protein, 6 aa, Artificial Sequence
  LCDR1
QSISSY

SEQ ID NO: 587 - protein, 3 aa, Artificial Sequence
  LCDR2
GAS

SEQ ID NO: 588 - protein, 12 aa, Artificial Sequence
  LCDR3
QTYYGGGPFGNG

SEQ ID NO: 589 - protein, 8 aa, Artificial Sequence
  HCDR1
GIDLSSNA

SEQ ID NO: 590 - protein, 7 aa, Artificial Sequence
  HCDR2
IYTSGST

SEQ ID NO: 591 - protein, 11 aa, Artificial Sequence
  HCDR3
ARGVTIDWFDL

SEQ ID NO: 592 - protein, 7 aa, Artificial Sequence
  LCDR1
PSVYSNY

SEQ ID NO: 593 - protein, 3 aa, Artificial Sequence
  LCDR2
GAS

SEQ ID NO: 594 - protein, 11 aa, Artificial Sequence
  LCDR3
LGGYGDINDTT

SEQ ID NO: 595 - protein, 8 aa, Artificial Sequence
  HCDR1
GFSLSSYV

SEQ ID NO: 596 - protein, 7 aa, Artificial Sequence
  HCDR2
IDYGGTA

SEQ ID NO: 597 - protein, 14 aa, Artificial Sequence
  HCDR3
ARGGYGGYILVTGL

SEQ ID NO: 598 - protein, 6 aa, Artificial Sequence
  LCDR1
QTIISY

SEQ ID NO: 599 - protein, 3 aa, Artificial Sequence
  LCDR2
GAS

SEQ ID NO: 600 - protein, 12 aa, Artificial Sequence
  LCDR3
QTYYGGGPFGNG

SEQ ID NO: 601 - protein, 8 aa, Artificial Sequence
  HCDR1
GIDLSSYA

SEQ ID NO: 602 - protein, 7 aa, Artificial Sequence
  HCDR2
IYTSNRT

SEQ ID NO: 603 - protein, 16 aa, Artificial Sequence
  HCDR3
GRYGRGSGGYYYGMDL

SEQ ID NO: 604 - protein, 6 aa, Artificial Sequence
  LCDR1
QSGDNY

SEQ ID NO: 605 - protein, 3 aa, Artificial Sequence
  LCDR2
QAS

SEQ ID NO: 606 - protein, 14 aa, Artificial Sequence
  LCDR3
QNYCAGSGVCLGIA

SEQ ID NO: 607 - protein, 8 aa, Artificial Sequence
  HCDR1
GIDFSSSS

SEQ ID NO: 608 - protein, 9 aa, Artificial Sequence
  HCDR2
IDTGSSGRT

SEQ ID NO: 609 - protein, 16 aa, Artificial Sequence
  HCDR3
TRYGDYAGYGYDSFDP

SEQ ID NO: 610 - protein, 6 aa, Artificial Sequence
  LCDR1
QNINNW

SEQ ID NO: 611 - protein, 3 aa, Artificial Sequence
  LCDR2
YAS

SEQ ID NO: 612 - protein, 12 aa, Artificial Sequence
  LCDR3
QQTFDCTDVENV

SEQ ID NO: 613 - protein, 8 aa, Artificial Sequence
  HCDR1
GFSLSSYD

SEQ ID NO: 614 - protein, 7 aa, Artificial Sequence
  HCDR2
INTDTTT

SEQ ID NO: 615 - protein, 11 aa, Artificial Sequence
  HCDR3
ARGNDPIYIDL

SEQ ID NO: 616 - protein, 8 aa, Artificial Sequence
  LCDR1
KSVINNNW

SEQ ID NO: 617 - protein, 3 aa, Artificial Sequence
  LCDR2
YAS

SEQ ID NO: 618 - protein, 11 aa, Artificial Sequence
  LCDR3
AGAYSPDSENA

SEQ ID NO: 619 - protein, 8 aa, Artificial Sequence
  HCDR1
GFSLSSYD

SEQ ID NO: 620 - protein, 7 aa, Artificial Sequence
  HCDR2
ITTNSDT

SEQ ID NO: 621 - protein, 9 aa, Artificial Sequence
  HCDR3
ARGYTTFTL

SEQ ID NO: 622 - protein, 6 aa, Artificial Sequence
  LCDR1
QNIYSN

SEQ ID NO: 623 - protein, 3 aa, Artificial Sequence
  LCDR2
GAS

SEQ ID NO: 624 - protein, 12 aa, Artificial Sequence
  LCDR3
QCTDYDSNYVVD

SEQ ID NO: 625 - protein, 9 aa, Artificial Sequence
  HCDR1
GFDLSSRYW

SEQ ID NO: 626 - protein, 8 aa, Artificial Sequence
  HCDR2
IKTGFSNT

SEQ ID NO: 627 - protein, 15 aa, Artificial Sequence
  HCDR3
ARIAAAASASDDFRL

SEQ ID NO: 628 - protein, 7 aa, Artificial Sequence
  LCDR1
KSVYNKW

SEQ ID NO: 629 - protein, 3 aa, Artificial Sequence
  LCDR2
DAS

SEQ ID NO: 630 - protein, 12 aa, Artificial Sequence
  LCDR3
LGHYDSSSDRFV

SEQ ID NO: 631 - protein, 8 aa, Artificial Sequence
  HCDR1
RFSLSTST

SEQ ID NO: 632 - protein, 7 aa, Artificial Sequence
  HCDR2
INGGGSA

SEQ ID NO: 633 - protein, 21 aa, Artificial Sequence
  HCDR3
ARSYDSYDDIYGTSRLYAFDP

SEQ ID NO: 634 - protein, 6 aa, Artificial Sequence
  LCDR1
ESIYAN

SEQ ID NO: 635 - protein, 3 aa, Artificial Sequence
  LCDR2
RAS

SEQ ID NO: 636 - protein, 12 aa, Artificial Sequence
  LCDR3
QQGYSSSNVDNS

SEQ ID NO: 637 - protein, 8 aa, Artificial Sequence
  HCDR1
GVDLSRYA

SEQ ID NO: 638 - protein, 7 aa, Artificial Sequence
  HCDR2
IWYSGTT

SEQ ID NO: 639 - protein, 15 aa, Artificial Sequence
  HCDR3
ARDPLYVGGNSGSDL

SEQ ID NO: 640 - protein, 6 aa, Artificial Sequence
  LCDR1
QSIGSS

SEQ ID NO: 641 - protein, 3 aa, Artificial Sequence
  LCDR2
YAS

SEQ ID NO: 642 - protein, 13 aa, Artificial Sequence
  LCDR3
QSNYGAASSSYGA

SEQ ID NO: 643 - protein, 9 aa, Artificial Sequence
  HCDR1
GIDFSSSFY

SEQ ID NO: 644 - protein, 8 aa, Artificial Sequence
  HCDR2
TYNRDGST

SEQ ID NO: 645 - protein, 15 aa, Artificial Sequence
  HCDR3
ARDDGYPGSGYVFNL

SEQ ID NO: 646 - protein, 6 aa, Artificial Sequence
  LCDR1
QSVSSY

SEQ ID NO: 647 - protein, 3 aa, Artificial Sequence
  LCDR2
GAS

SEQ ID NO: 648 - protein, 13 aa, Artificial Sequence
  LCDR3
QGGYYSSGADNNS

SEQ ID NO: 649 - protein, 8 aa, Artificial Sequence
  HCDR1
GLSLSSYD

SEQ ID NO: 650 - protein, 7 aa, Artificial Sequence
  HCDR2
IWSGGTT

SEQ ID NO: 651 - protein, 9 aa, Artificial Sequence
  HCDR3
ARGYVEFDL

SEQ ID NO: 652 - protein, 8 aa, Artificial Sequence
  LCDR1
QSLYSNNY

SEQ ID NO: 653 - protein, 3 aa, Artificial Sequence
  LCDR2
PAS

SEQ ID NO: 654 - protein, 12 aa, Artificial Sequence
  LCDR3
QGTFYDSGWLST

SEQ ID NO: 655 - protein, 9 aa, Artificial Sequence
  HCDR1
GFSFNNNYV

SEQ ID NO: 656 - protein, 8 aa, Artificial Sequence
  HCDR2
IYVVSGST

SEQ ID NO: 657 - protein, 14 aa, Artificial Sequence
  HCDR3
ARDQLYNSGYDFDL

SEQ ID NO: 658 - protein, 8 aa, Artificial Sequence
  LCDR1
QSVYNNNE

SEQ ID NO: 659 - protein, 3 aa, Artificial Sequence
  LCDR2
QAS

SEQ ID NO: 660 - protein, 12 aa, Artificial Sequence
  LCDR3
QGTYYRSGLDNG

SEQ ID NO: 661 - protein, 9 aa, Artificial Sequence
  HCDR1
GIDFSSSYY

SEQ ID NO: 662 - protein, 8 aa, Artificial Sequence
  HCDR2
TYNRDGST

SEQ ID NO: 663 - protein, 15 aa, Artificial Sequence
  HCDR3
ARDDGYPGSGYVLNL

SEQ ID NO: 664 - protein, 6 aa, Artificial Sequence
  LCDR1
QSVSNY

SEQ ID NO: 665 - protein, 3 aa, Artificial Sequence
  LCDR2
GAS

SEQ ID NO: 666 - protein, 13 aa, Artificial Sequence
  LCDR3
QGGYYSSNTDNNS

SEQ ID NO: 667 - protein, 8 aa, Artificial Sequence
  HCDR1
GFSLSSYY

SEQ ID NO: 668 - protein, 7 aa, Artificial Sequence
  HCDR2
ISTAGNT

SEQ ID NO: 669 - protein, 14 aa, Artificial Sequence
  HCDR3
ARDGAGDSNYYRNL

SEQ ID NO: 670 - protein, 6 aa, Artificial Sequence
  LCDR1
QSIDRF

SEQ ID NO: 671 - protein, 3 aa, Artificial Sequence
  LCDR2
DAS

SEQ ID NO: 672 - protein, 12 aa, Artificial Sequence
  LCDR3
QQGYYISDIHNV

SEQ ID NO: 673 - protein, 8 aa, Artificial Sequence
  HCDR1
GFSLSSYW

SEQ ID NO: 674 - protein, 8 aa, Artificial Sequence
  HCDR2
IYAGSGSA

SEQ ID NO: 675 - protein, 14 aa, Artificial Sequence
  HCDR3
GRGNYDGYINVYDL

SEQ ID NO: 676 - protein, 6 aa, Artificial Sequence
  LCDR1
QSIGSY

SEQ ID NO: 677 - protein, 3 aa, Artificial Sequence
  LCDR2
AAA

SEQ ID NO: 678 - protein, 14 aa, Artificial Sequence
  LCDR3
QNNNGAYGSAYVGA

SEQ ID NO: 679 - protein, 8 aa, Artificial Sequence
  HCDR1
GIDLSSYA

SEQ ID NO: 680 - protein, 8 aa, Artificial Sequence
  HCDR2
IYVGSTTT

SEQ ID NO: 681 - protein, 18 aa, Artificial Sequence
  HCDR3
ARAYDSGYIGNSFYIFHP

SEQ ID NO: 682 - protein, 6 aa, Artificial Sequence
  LCDR1
QTISSR

SEQ ID NO: 683 - protein, 3 aa, Artificial Sequence
  LCDR2
SAS

SEQ ID NO: 684 - protein, 10 aa, Artificial Sequence
  LCDR3
AGYGGLGITA

SEQ ID NO: 685 - protein, 8 aa, Artificial Sequence
  HCDR1
GFSLSSNA

SEQ ID NO: 686 - protein, 7 aa, Artificial Sequence
  HCDR2
INTGGST

SEQ ID NO: 687 - protein, 14 aa, Artificial Sequence
  HCDR3
ARDVGDSRGYYWGL

SEQ ID NO: 688 - protein, 6 aa, Artificial Sequence
  LCDR1
EDIYSL

SEQ ID NO: 689 - protein, 3 aa, Artificial Sequence
  LCDR2
DAS

SEQ ID NO: 690 - protein, 13 aa, Artificial Sequence
  LCDR3
QQGYTTYTTVDNI

SEQ ID NO: 691 - protein, 8 aa, Artificial Sequence
  HCDR1
GIDLSSYA

SEQ ID NO: 692 - protein, 7 aa, Artificial Sequence
  HCDR2
IYTSNRT

SEQ ID NO: 693 - protein, 16 aa, Artificial Sequence
  HCDR3
GRYGRGSGGYYYGMDL

SEQ ID NO: 694 - protein, 6 aa, Artificial Sequence
  LCDR1
QSGDDY

SEQ ID NO: 695 - protein, 3 aa, Artificial Sequence
  LCDR2
AAS

SEQ ID NO: 696 - protein, 14 aa, Artificial Sequence
  LCDR3
QNYCAGSGVCLGVA

SEQ ID NO: 697 - protein, 8 aa, Artificial Sequence
  HCDR1
GFSLSSYA

SEQ ID NO: 698 - protein, 7 aa, Artificial Sequence
  HCDR2
LYRNDAA

SEQ ID NO: 699 - protein, 12 aa, Artificial Sequence
  HCDR3
VRGYVNDGYYNL

SEQ ID NO: 700 - protein, 6 aa, Artificial Sequence
  LCDR1
ESIGYR

SEQ ID NO: 701 - protein, 3 aa, Artificial Sequence
  LCDR2
DAS

SEQ ID NO: 702 - protein, 12 aa, Artificial Sequence
  LCDR3
QQDYSYSITDNC

SEQ ID NO: 703 - protein, 9 aa, Artificial Sequence
  HCDR1
GFSFSSGYD

SEQ ID NO: 704 - protein, 9 aa, Artificial Sequence
  HCDR2
IYAGSNNNT

SEQ ID NO: 705 - protein, 20 aa, Artificial Sequence
  HCDR3
ARAAGGYADYAYVMGDYFNF

SEQ ID NO: 706 - protein, 6 aa, Artificial Sequence
  LCDR1
EDIYSI

SEQ ID NO: 707 - protein, 3 aa, Artificial Sequence
  LCDR2
SAS

SEQ ID NO: 708 - protein, 12 aa, Artificial Sequence
  LCDR3
QQGYSSSNVDNV

SEQ ID NO: 709 - protein, 9 aa, Artificial Sequence
  HCDR1
GFDFSSNYY

SEQ ID NO: 710 - protein, 8 aa, Artificial Sequence
  HCDR2
DSGSSGST

SEQ ID NO: 711 - protein, 15 aa, Artificial Sequence
  HCDR3
VRDDVGSSYEYYFSL

SEQ ID NO: 712 - protein, 6 aa, Artificial Sequence
  LCDR1
QSIGSF

SEQ ID NO: 713 - protein, 3 aa, Artificial Sequence
  LCDR2
QAS

SEQ ID NO: 714 - protein, 10 aa, Artificial Sequence
  LCDR3
QTYFGSDSYV

SEQ ID NO: 715 - protein, 9 aa, Artificial Sequence
  HCDR1
GFSFSSGGW

SEQ ID NO: 716 - protein, 9 aa, Artificial Sequence
  HCDR2
IYVGSSGTT

SEQ ID NO: 717 - protein, 16 aa, Artificial Sequence
  HCDR3
ARGAVYGGGSYDNFHL

SEQ ID NO: 718 - protein, 6 aa, Artificial Sequence
  LCDR1
QSIGSY

SEQ ID NO: 719 - protein, 3 aa, Artificial Sequence
  LCDR2
AAS

SEQ ID NO: 720 - protein, 12 aa, Artificial Sequence
  LCDR3
QQGYNISNLDNT

SEQ ID NO: 721 - protein, 9 aa, Artificial Sequence
  HCDR1
GFSFSRNNY

SEQ ID NO: 722 - protein, 9 aa, Artificial Sequence
  HCDR2
IHDGNSVGI

SEQ ID NO: 723 - protein, 12 aa, Artificial Sequence
  HCDR3
ARMSYTNDWDPI

SEQ ID NO: 724 - protein, 6 aa, Artificial Sequence
  LCDR1
ENIYSL

SEQ ID NO: 725 - protein, 3 aa, Artificial Sequence
  LCDR2
LAS

SEQ ID NO: 726 - protein, 14 aa, Artificial Sequence
  LCDR3
QGYYYSSSTSYENA

SEQ ID NO: 727 - protein, 8 aa, Artificial Sequence
  HCDR1
GFSLSDYN

SEQ ID NO: 728 - protein, 7 aa, Artificial Sequence
  HCDR2
ISLGGTT

SEQ ID NO: 729 - protein, 14 aa, Artificial Sequence
  HCDR3
ARDPAGGNWAELDL

SEQ ID NO: 730 - protein, 6 aa, Artificial Sequence
  LCDR1
QSISSW

SEQ ID NO: 731 - protein, 3 aa, Artificial Sequence
  LCDR2
DAS

SEQ ID NO: 732 - protein, 12 aa, Artificial Sequence
  LCDR3
QQGSTISNVDNA

SEQ ID NO: 733 - protein, 9 aa, Artificial Sequence
  HCDR1
GLDFSSSYW

SEQ ID NO: 734 - protein, 9 aa, Artificial Sequence
  HCDR2
IHAGSSGTT

SEQ ID NO: 735 - protein, 16 aa, Artificial Sequence
  HCDR3
ARGAVYGGGSYDNFNL

SEQ ID NO: 736 - protein, 6 aa, Artificial Sequence
  LCDR1
QSIGTY

SEQ ID NO: 737 - protein, 3 aa, Artificial Sequence
  LCDR2
AAS

SEQ ID NO: 738 - protein, 12 aa, Artificial Sequence
  LCDR3
QQGYSADNVANS

SEQ ID NO: 739 - protein, 8 aa, Artificial Sequence
  HCDR1
GFSLSNYS

SEQ ID NO: 740 - protein, 7 aa, Artificial Sequence
  HCDR2
INTYGSA

SEQ ID NO: 741 - protein, 15 aa, Artificial Sequence
  HCDR3
ARDAGGSTVPWFFDV

SEQ ID NO: 742 - protein, 6 aa, Artificial Sequence
  LCDR1
QTISNY

SEQ ID NO: 743 - protein, 3 aa, Artificial Sequence
  LCDR2
DAS

SEQ ID NO: 744 - protein, 12 aa, Artificial Sequence
  LCDR3
QQGYADSNVDNV

SEQ ID NO: 745 - protein, 9 aa, Artificial Sequence
  HCDR1
GFSFSDRHY

SEQ ID NO: 746 - protein, 8 aa, Artificial Sequence
  HCDR2
IYTGKDSI

SEQ ID NO: 747 - protein, 15 aa, Artificial Sequence
  HCDR3
ARDLLYGSSSGYLHT

SEQ ID NO: 748 - protein, 6 aa, Artificial Sequence
  LCDR1
HNIYSN

SEQ ID NO: 749 - protein, 3 aa, Artificial Sequence
  LCDR2
YAS

SEQ ID NO: 750 - protein, 11 aa, Artificial Sequence
  LCDR3
QSAYYGSIDIT

SEQ ID NO: 751 - protein, 8 aa, Artificial Sequence
  HCDR1
GFSFSSNA

SEQ ID NO: 752 - protein, 9 aa, Artificial Sequence
  HCDR2
IYVDSIGST

SEQ ID NO: 753 - protein, 11 aa, Artificial Sequence
  HCDR3
ARGDNIAYFML

SEQ ID NO: 754 - protein, 6 aa, Artificial Sequence
  LCDR1
ESITSF

SEQ ID NO: 755 - protein, 3 aa, Artificial Sequence
  LCDR2
KIS

SEQ ID NO: 756 - protein, 15 aa, Artificial Sequence
  LCDR3
QGYYYYSNVVYASNG

SEQ ID NO: 757 - protein, 8 aa, Artificial Sequence
  HCDR1
GFTISSYE

SEQ ID NO: 758 - protein, 7 aa, Artificial Sequence
  HCDR2
IASGGST

SEQ ID NO: 759 - protein, 9 aa, Artificial Sequence
  HCDR3
ARGYVEFKL

SEQ ID NO: 760 - protein, 6 aa, Artificial Sequence
  LCDR1
QSIGSY

SEQ ID NO: 761 - protein, 3 aa, Artificial Sequence
  LCDR2
RAS

SEQ ID NO: 762 - protein, 11 aa, Artificial Sequence
  LCDR3
QGYHSTSGYVA

SEQ ID NO: 763 - protein, 9 aa, Artificial Sequence
  HCDR1
GFSFSSSYY

SEQ ID NO: 764 - protein, 8 aa, Artificial Sequence
  HCDR2
IDTADAYT

SEQ ID NO: 765 - protein, 14 aa, Artificial Sequence
  HCDR3
ARERIAYNTDYFNL

SEQ ID NO: 766 - protein, 8 aa, Artificial Sequence
  LCDR1
QSLYNYNN

SEQ ID NO: 767 - protein, 3 aa, Artificial Sequence
  LCDR2
SAS

SEQ ID NO: 768 - protein, 10 aa, Artificial Sequence
  LCDR3
QGYYSGAVYT

SEQ ID NO: 769 - protein, 8 aa, Artificial Sequence
  HCDR1
GFSLSSYD

SEQ ID NO: 770 - protein, 7 aa, Artificial Sequence
  HCDR2
IWSDGDT

SEQ ID NO: 771 - protein, 9 aa, Artificial Sequence
  HCDR3
ARGYTNYDL

SEQ ID NO: 772 - protein, 8 aa, Artificial Sequence
  LCDR1
QSLYSDPY

SEQ ID NO: 773 - protein, 3 aa, Artificial Sequence
  LCDR2
QAS

SEQ ID NO: 774 - protein, 12 aa, Artificial Sequence
  LCDR3
QGTYYSDGWYSD

SEQ ID NO: 775 - protein, 8 aa, Artificial Sequence
  HCDR1
GFTLSSFY

SEQ ID NO: 776 - protein, 7 aa, Artificial Sequence
  HCDR2
IHGHGNT

SEQ ID NO: 777 - protein, 10 aa, Artificial Sequence
  HCDR3
ARGGHPNMDL

SEQ ID NO: 778 - protein, 6 aa, Artificial Sequence
  LCDR1
QNINNY

SEQ ID NO: 779 - protein, 3 aa, Artificial Sequence
  LCDR2
YAS

SEQ ID NO: 780 - protein, 12 aa, Artificial Sequence
  LCDR3
QCSYYDASIFGA

SEQ ID NO: 781 - protein, 9 aa, Artificial Sequence
  HCDR1
GFSFSSSYY

SEQ ID NO: 782 - protein, 8 aa, Artificial Sequence
  HCDR2
IDTVDNYT

SEQ ID NO: 783 - protein, 14 aa, Artificial Sequence
  HCDR3
ARERIAYNTDYFNL

SEQ ID NO: 784 - protein, 8 aa, Artificial Sequence
  LCDR1
QSLYNYNN

SEQ ID NO: 785 - protein, 3 aa, Artificial Sequence
  LCDR2
SVS

SEQ ID NO: 786 - protein, 10 aa, Artificial Sequence
  LCDR3
QGYYSGAVYT

SEQ ID NO: 787 - protein, 8 aa, Artificial Sequence
  HCDR1
GFSLNYYS

SEQ ID NO: 788 - protein, 7 aa, Artificial Sequence
  HCDR2
INTGGGT

SEQ ID NO: 789 - protein, 13 aa, Artificial Sequence
  HCDR3
ARSDGTGITYYNL

SEQ ID NO: 790 - protein, 6 aa, Artificial Sequence
  LCDR1
ETIYSN

SEQ ID NO: 791 - protein, 3 aa, Artificial Sequence
  LCDR2
RAS

SEQ ID NO: 792 - protein, 10 aa, Artificial Sequence
  LCDR3
QGYYNTGITG

SEQ ID NO: 793 - protein, 8 aa, Artificial Sequence
  HCDR1
GFSLSTYA

SEQ ID NO: 794 - protein, 8 aa, Artificial Sequence
  HCDR2
INTDSGDT

SEQ ID NO: 795 - protein, 10 aa, Artificial Sequence
  HCDR3
ARNPGDDVNL

SEQ ID NO: 796 - protein, 8 aa, Artificial Sequence
  LCDR1
QSVYNNND

SEQ ID NO: 797 - protein, 3 aa, Artificial Sequence
  LCDR2
RTS

SEQ ID NO: 798 - protein, 10 aa, Artificial Sequence
  LCDR3
QGYYSGVIYV

SEQ ID NO: 799 - protein, 8 aa, Artificial Sequence
  HCDR1
GIDLSSYS

SEQ ID NO: 800 - protein, 7 aa, Artificial Sequence
  HCDR2
INTGGRG

SEQ ID NO: 801 - protein, 14 aa, Artificial Sequence
  HCDR3
ARDAGSSRGYYRDL

SEQ ID NO: 802 - protein, 6 aa, Artificial Sequence
  LCDR1
EDIYSL

SEQ ID NO: 803 - protein, 3 aa, Artificial Sequence
  LCDR2
DAS

SEQ ID NO: 804 - protein, 13 aa, Artificial Sequence
  LCDR3
QQGYTTSTTVDNI

SEQ ID NO: 805 - protein, 8 aa, Artificial Sequence
  HCDR1
GIDLSRHA

SEQ ID NO: 806 - protein, 7 aa, Artificial Sequence
  HCDR2
IYASGST

SEQ ID NO: 807 - protein, 11 aa, Artificial Sequence
  HCDR3
ARGITIEWFDL

SEQ ID NO: 808 - protein, 7 aa, Artificial Sequence
  LCDR1
PSVYSNY

SEQ ID NO: 809 - protein, 3 aa, Artificial Sequence
  LCDR2
GAA

SEQ ID NO: 810 - protein, 11 aa, Artificial Sequence
  LCDR3
LGGYSDTADTI

SEQ ID NO: 811 - protein, 8 aa, Artificial Sequence
  HCDR1
GFSLNNYD

SEQ ID NO: 812 - protein, 7 aa, Artificial Sequence
  HCDR2
IDTGGSA

SEQ ID NO: 813 - protein, 9 aa, Artificial Sequence
  HCDR3
ARGYTHGYL

SEQ ID NO: 814 - protein, 6 aa, Artificial Sequence
  LCDR1
QNVYNN

SEQ ID NO: 815 - protein, 3 aa, Artificial Sequence
  LCDR2
SAS

SEQ ID NO: 816 - protein, 13 aa, Artificial Sequence
  LCDR3
QSADWESSNFFWA

SEQ ID NO: 817 - protein, 8 aa, Artificial Sequence
  HCDR1
GFSLSTYA

SEQ ID NO: 818 - protein, 7 aa, Artificial Sequence
  HCDR2
ITTGGST

SEQ ID NO: 819 - protein, 15 aa, Artificial Sequence
  HCDR3
ARGGDTGYGFSYFDL

SEQ ID NO: 820 - protein, 6 aa, Artificial Sequence
  LCDR1
ENIYSS

SEQ ID NO: 821 - protein, 3 aa, Artificial Sequence
  LCDR2
DAS

SEQ ID NO: 822 - protein, 12 aa, Artificial Sequence
  LCDR3
QQGYSTSNLVNP

SEQ ID NO: 823 - protein, 9 aa, Artificial Sequence
  HCDR1
GFSFSSDYY

SEQ ID NO: 824 - protein, 9 aa, Artificial Sequence
  HCDR2
ISAGSSGSI

SEQ ID NO: 825 - protein, 15 aa, Artificial Sequence
  HCDR3
AREASDSIYYPIFNL

SEQ ID NO: 826 - protein, 8 aa, Artificial Sequence
  LCDR1
KSVYNNNA

SEQ ID NO: 827 - protein, 3 aa, Artificial Sequence
  LCDR2
GAS

SEQ ID NO: 828 - protein, 12 aa, Artificial Sequence
  LCDR3
IGGYSSSSDTNA

SEQ ID NO: 829 - protein, 8 aa, Artificial Sequence
  HCDR1
GFSLSNYA

SEQ ID NO: 830 - protein, 7 aa, Artificial Sequence
  HCDR2
IYASGTT

SEQ ID NO: 831 - protein, 20 aa, Artificial Sequence
  HCDR3
AREYDSYDYAYGSSIYAFDP

SEQ ID NO: 832 - protein, 6 aa, Artificial Sequence
  LCDR1
ESIYSN

SEQ ID NO: 833 - protein, 3 aa, Artificial Sequence
  LCDR2
RAS

SEQ ID NO: 834 - protein, 12 aa, Artificial Sequence
  LCDR3
QQGYSSSNVDNV

SEQ ID NO: 835 - protein, 8 aa, Artificial Sequence
  HCDR1
GFTISSHH

SEQ ID NO: 836 - protein, 7 aa, Artificial Sequence
  HCDR2
IYPSGTT

SEQ ID NO: 837 - protein, 9 aa, Artificial Sequence
  HCDR3
VRDVGYFTL

SEQ ID NO: 838 - protein, 8 aa, Artificial Sequence
  LCDR1
QSVGGNNW

SEQ ID NO: 839 - protein, 3 aa, Artificial Sequence
  LCDR2
YAS

SEQ ID NO: 840 - protein, 10 aa, Artificial Sequence
  LCDR3
QGYYSDVTNA

SEQ ID NO: 841 - protein, 8 aa, Artificial Sequence
  HCDR1
RFSLSTST

SEQ ID NO: 842 - protein, 7 aa, Artificial Sequence
  HCDR2
INGGGSA

SEQ ID NO: 843 - protein, 21 aa, Artificial Sequence
  HCDR3
ARSYDSYDDIYGTSRLYAFDP

SEQ ID NO: 844 - protein, 6 aa, Artificial Sequence
  LCDR1
ESIYSN

SEQ ID NO: 845 - protein, 3 aa, Artificial Sequence
  LCDR2
RAS

SEQ ID NO: 846 - protein, 12 aa, Artificial Sequence
  LCDR3
QQGYSSSDVDNA

SEQ ID NO: 847 - protein, 8 aa, Artificial Sequence
  HCDR1
GIDLSSYG

SEQ ID NO: 848 - protein, 7 aa, Artificial Sequence
  HCDR2
ISTIGDT

SEQ ID NO: 849 - protein, 16 aa, Artificial Sequence
  HCDR3
ARYTNSGYAMMYYFNL

SEQ ID NO: 850 - protein, 6 aa, Artificial Sequence
  LCDR1
QNIVNA

SEQ ID NO: 851 - protein, 3 aa, Artificial Sequence
  LCDR2
VAS

SEQ ID NO: 852 - protein, 15 aa, Artificial Sequence
  LCDR3
QSYYYSSGTSYGQNA

SEQ ID NO: 853 - protein, 9 aa, Artificial Sequence
  HCDR1
GIDFSSSYY

SEQ ID NO: 854 - protein, 8 aa, Artificial Sequence
  HCDR2
IDTVDDYT

SEQ ID NO: 855 - protein, 14 aa, Artificial Sequence
  HCDR3
ARERIDNNTDCFDL

SEQ ID NO: 856 - protein, 8 aa, Artificial Sequence
  LCDR1
QSVVSKNR

SEQ ID NO: 857 - protein, 3 aa, Artificial Sequence
  LCDR2
LAS

SEQ ID NO: 858 - protein, 10 aa, Artificial Sequence
  LCDR3
QGYYSGAIYA

SEQ ID NO: 859 - protein, 8 aa, Artificial Sequence
  HCDR1
GIDLNNNA

SEQ ID NO: 860 - protein, 7 aa, Artificial Sequence
  HCDR2
ISTAGTT

SEQ ID NO: 861 - protein, 13 aa, Artificial Sequence
  HCDR3
ARAAYFSYGYINL

SEQ ID NO: 862 - protein, 6 aa, Artificial Sequence
  LCDR1
QNIGNA

SEQ ID NO: 863 - protein, 3 aa, Artificial Sequence
  LCDR2
SAS

SEQ ID NO: 864 - protein, 10 aa, Artificial Sequence
  LCDR3
QSYVYSDGNV

SEQ ID NO: 865 - protein, 8 aa, Artificial Sequence
  HCDR1
GFSLSSYD

SEQ ID NO: 866 - protein, 7 aa, Artificial Sequence
  HCDR2
VSTGGSA

SEQ ID NO: 867 - protein, 10 aa, Artificial Sequence
  HCDR3
ARIISGGRDL

SEQ ID NO: 868 - protein, 6 aa, Artificial Sequence
  LCDR1
ESISSR

SEQ ID NO: 869 - protein, 3 aa, Artificial Sequence
  LCDR2
SAS

SEQ ID NO: 870 - protein, 16 aa, Artificial Sequence
  LCDR3
QSYYYSSTASYASNNA

SEQ ID NO: 871 - protein, 8 aa, Artificial Sequence
  HCDR1
GFSLNTYV

SEQ ID NO: 872 - protein, 7 aa, Artificial Sequence
  HCDR2
IDYGGAP

SEQ ID NO: 873 - protein, 14 aa, Artificial Sequence
  HCDR3
ARGGYGGYVLVTVL

SEQ ID NO: 874 - protein, 6 aa, Artificial Sequence
  LCDR1
QNIYSS

SEQ ID NO: 875 - protein, 3 aa, Artificial Sequence
  LCDR2
QAS

SEQ ID NO: 876 - protein, 12 aa, Artificial Sequence
  LCDR3
QTYYGGSTYGNG

SEQ ID NO: 877 - protein, 8 aa, Artificial Sequence
  HCDR1
GFSLSNYY

SEQ ID NO: 878 - protein, 7 aa, Artificial Sequence
  HCDR2
ISTAGNT

SEQ ID NO: 879 - protein, 14 aa, Artificial Sequence
  HCDR3
ARDGAGDSNYYRNL

SEQ ID NO: 880 - protein, 6 aa, Artificial Sequence
  LCDR1
QSIDRF

SEQ ID NO: 881 - protein, 3 aa, Artificial Sequence
  LCDR2
DAS

SEQ ID NO: 882 - protein, 12 aa, Artificial Sequence
  LCDR3
QQGYSISDIDNV

SEQ ID NO: 883 - protein, 9 aa, Artificial Sequence
  HCDR1
GFSFNSNYW

SEQ ID NO: 884 - protein, 8 aa, Artificial Sequence
  HCDR2
IMTGDGST

SEQ ID NO: 885 - protein, 19 aa, Artificial Sequence
  HCDR3
ARGYDGIHGGDNYGHVFNL

SEQ ID NO: 886 - protein, 6 aa, Artificial Sequence
  LCDR1
ENIYSL

SEQ ID NO: 887 - protein, 3 aa, Artificial Sequence
  LCDR2
RAS

SEQ ID NO: 888 - protein, 10 aa, Artificial Sequence
  LCDR3
QSYYINSSNS

SEQ ID NO: 889 - protein, 8 aa, Artificial Sequence
  HCDR1
EFDFNNNA

SEQ ID NO: 890 - protein, 8 aa, Artificial Sequence
  HCDR2
IYIGNGGT

SEQ ID NO: 891 - protein, 11 aa, Artificial Sequence
  HCDR3
ARGENIAYFIL

SEQ ID NO: 892 - protein, 6 aa, Artificial Sequence
  LCDR1
QSINSW

SEQ ID NO: 893 - protein, 3 aa, Artificial Sequence
  LCDR2
KAS

SEQ ID NO: 894 - protein, 15 aa, Artificial Sequence
  LCDR3
QGYYYYSSSNYASNA

SEQ ID NO: 895 - protein, 8 aa, Artificial Sequence
  HCDR1
GFSLSSYW

SEQ ID NO: 896 - protein, 8 aa, Artificial Sequence
  HCDR2
IYGGSGDK

SEQ ID NO: 897 - protein, 13 aa, Artificial Sequence
  HCDR3
ARGGDGDGTYSSL

SEQ ID NO: 898 - protein, 7 aa, Artificial Sequence
  LCDR1
ESVAGKN

SEQ ID NO: 899 - protein, 3 aa, Artificial Sequence
  LCDR2
GTS

SEQ ID NO: 900 - protein, 10 aa, Artificial Sequence
  LCDR3
QGYYSGGIYG

SEQ ID NO: 901 - protein, 8 aa, Artificial Sequence
  HCDR1
GIDLSSYA

SEQ ID NO: 902 - protein, 7 aa, Artificial Sequence
  HCDR2
ITYGGST

SEQ ID NO: 903 - protein, 15 aa, Artificial Sequence
  HCDR3
ARLRAPYYYRIYFNL

SEQ ID NO: 904 - protein, 6 aa, Artificial Sequence
  LCDR1
QNIISA

SEQ ID NO: 905 - protein, 3 aa, Artificial Sequence
  LCDR2
DAS

SEQ ID NO: 906 - protein, 10 aa, Artificial Sequence
  LCDR3
QGAYDTNIND

SEQ ID NO: 907 - protein, 8 aa, Artificial Sequence
  HCDR1
GFSFSSYW

SEQ ID NO: 908 - protein, 8 aa, Artificial Sequence
  HCDR2
IATHSGTD

SEQ ID NO: 909 - protein, 14 aa, Artificial Sequence
  HCDR3
ARDPYGFNGDYFSL

SEQ ID NO: 910 - protein, 8 aa, Artificial Sequence
  LCDR1
QSVYNSNY

SEQ ID NO: 911 - protein, 3 aa, Artificial Sequence
  LCDR2
KAS

SEQ ID NO: 912 - protein, 12 aa, Artificial Sequence
  LCDR3
AGYKSYTNDDNG

SEQ ID NO: 913 - protein, 8 aa, Artificial Sequence
  HCDR1
GFSLNNYG

SEQ ID NO: 914 - protein, 7 aa, Artificial Sequence
  HCDR2
INYGGIA

SEQ ID NO: 915 - protein, 12 aa, Artificial Sequence
  HCDR3
ARGYGYYSAGNL

SEQ ID NO: 916 - protein, 8 aa, Artificial Sequence
  LCDR1
QSVYDNNY

SEQ ID NO: 917 - protein, 3 aa, Artificial Sequence
  LCDR2
DAS

SEQ ID NO: 918 - protein, 13 aa, Artificial Sequence
  LCDR3
AGEYSCLSDDCIA

SEQ ID NO: 919 - protein, 8 aa, Artificial Sequence
  HCDR1
GFSLSNYY

SEQ ID NO: 920 - protein, 7 aa, Artificial Sequence
  HCDR2
IGSGVST

SEQ ID NO: 921 - protein, 14 aa, Artificial Sequence
  HCDR3
ARDMYVGNWGDWGL

SEQ ID NO: 922 - protein, 6 aa, Artificial Sequence
  LCDR1
QSISNN

SEQ ID NO: 923 - protein, 3 aa, Artificial Sequence
  LCDR2
SVS

SEQ ID NO: 924 - protein, 12 aa, Artificial Sequence
  LCDR3
QQDYRIGDLDSA

SEQ ID NO: 925 - protein, 8 aa, Artificial Sequence
  HCDR1
GFSLSRYD

SEQ ID NO: 926 - protein, 7 aa, Artificial Sequence
  HCDR2
IWSDGDT

SEQ ID NO: 927 - protein, 9 aa, Artificial Sequence
  HCDR3
GRGYTAWNL

SEQ ID NO: 928 - protein, 8 aa, Artificial Sequence
  LCDR1
ESVVGNNA

SEQ ID NO: 929 - protein, 3 aa, Artificial Sequence
  LCDR2
QAS

SEQ ID NO: 930 - protein, 12 aa, Artificial Sequence
  LCDR3
QGTYYSSGWYFA

SEQ ID NO: 931 - protein, 8 aa, Artificial Sequence
  HCDR1
GFSLNSYD

SEQ ID NO: 932 - protein, 7 aa, Artificial Sequence
  HCDR2
IWSDGNT

SEQ ID NO: 933 - protein, 9 aa, Artificial Sequence
  HCDR3
ARGYTGFFL

SEQ ID NO: 934 - protein, 7 aa, Artificial Sequence
  LCDR1
QSIGSSY

SEQ ID NO: 935 - protein, 3 aa, Artificial Sequence
  LCDR2
EAS

SEQ ID NO: 936 - protein, 12 aa, Artificial Sequence
  LCDR3
QCTYYGGSWRVA

SEQ ID NO: 937 - protein, 9 aa, Artificial Sequence
  HCDR1
GFSLNSNYY

SEQ ID NO: 938 - protein, 8 aa, Artificial Sequence
  HCDR2
IDAGSGST

SEQ ID NO: 939 - protein, 15 aa, Artificial Sequence
  HCDR3
ARDDIGTSYEYYFGL

SEQ ID NO: 940 - protein, 6 aa, Artificial Sequence
  LCDR1
QTISSY

SEQ ID NO: 941 - protein, 3 aa, Artificial Sequence
  LCDR2
SAS

SEQ ID NO: 942 - protein, 10 aa, Artificial Sequence
  LCDR3
QTYYGSDSYV

SEQ ID NO: 943 - protein, 8 aa, Artificial Sequence
  HCDR1
GFSLSSNA

SEQ ID NO: 944 - protein, 7 aa, Artificial Sequence
  HCDR2
INTGSST

SEQ ID NO: 945 - protein, 14 aa, Artificial Sequence
  HCDR3
ARDADDSRGYYWGL

SEQ ID NO: 946 - protein, 6 aa, Artificial Sequence
  LCDR1
EDIYSL

SEQ ID NO: 947 - protein, 3 aa, Artificial Sequence
  LCDR2
DAS

SEQ ID NO: 948 - protein, 13 aa, Artificial Sequence
  LCDR3
QQGYTTYTTVDNI

SEQ ID NO: 949 - protein, 8 aa, Artificial Sequence
  HCDR1
GIDLSSYA

SEQ ID NO: 950 - protein, 7 aa, Artificial Sequence
  HCDR2
IYASNRT

SEQ ID NO: 951 - protein, 16 aa, Artificial Sequence
  HCDR3
GRYGRGSGGYYYGMDL

SEQ ID NO: 952 - protein, 6 aa, Artificial Sequence
  LCDR1
QSGDNY

SEQ ID NO: 953 - protein, 3 aa, Artificial Sequence
  LCDR2
LAS

SEQ ID NO: 954 - protein, 14 aa, Artificial Sequence
  LCDR3
QNYCAGSGVCVGVA

SEQ ID NO: 955 - protein, 9 aa, Artificial Sequence
  HCDR1
GFSFSSSYW

SEQ ID NO: 956 - protein, 9 aa, Artificial Sequence
  HCDR2
IYAGTFSDT

SEQ ID NO: 957 - protein, 25 aa, Artificial Sequence
  HCDR3
ARGHYYYTDNYTANGYGRGLTRLDL

SEQ ID NO: 958 - protein, 8 aa, Artificial Sequence
  LCDR1
QSVYNNNN

SEQ ID NO: 959 - protein, 3 aa, Artificial Sequence
  LCDR2
GAS

SEQ ID NO: 960 - protein, 11 aa, Artificial Sequence
  LCDR3
AGGYTTSGDNG

SEQ ID NO: 961 - protein, 8 aa, Artificial Sequence
  HCDR1
GFSLSSYD

SEQ ID NO: 962 - protein, 7 aa, Artificial Sequence
  HCDR2
IYLTDTT

SEQ ID NO: 963 - protein, 15 aa, Artificial Sequence
  HCDR3
ARHLDTSSGGFYFNL

SEQ ID NO: 964 - protein, 8 aa, Artificial Sequence
  LCDR1
QSVYNSKI

SEQ ID NO: 965 - protein, 3 aa, Artificial Sequence
  LCDR2
DAS

SEQ ID NO: 966 - protein, 13 aa, Artificial Sequence
  LCDR3
QGEFTCTSADCIA

SEQ ID NO: 967 - protein, 8 aa, Artificial Sequence
  HCDR1
GIDLSSNA

SEQ ID NO: 968 - protein, 7 aa, Artificial Sequence
  HCDR2
IGFAGIT

SEQ ID NO: 969 - protein, 13 aa, Artificial Sequence
  HCDR3
ARAYGDSDGLYNL

SEQ ID NO: 970 - protein, 8 aa, Artificial Sequence
  LCDR1
ESVYNNNW

SEQ ID NO: 971 - protein, 3 aa, Artificial Sequence
  LCDR2
LAS

SEQ ID NO: 972 - protein, 10 aa, Artificial Sequence
  LCDR3
QGGYSGNIFA

SEQ ID NO: 973 - protein, 9 aa, Artificial Sequence
  HCDR1
GLDFSTNYY

SEQ ID NO: 974 - protein, 8 aa, Artificial Sequence
  HCDR2
ISTSSGNT

SEQ ID NO: 975 - protein, 18 aa, Artificial Sequence
  HCDR3
ARCDIVYVGYGYASRLDL

SEQ ID NO: 976 - protein, 8 aa, Artificial Sequence
  LCDR1
ESVYNNNN

SEQ ID NO: 977 - protein, 3 aa, Artificial Sequence
  LCDR2
GAS

SEQ ID NO: 978 - protein, 10 aa, Artificial Sequence
  LCDR3
AGGGSTSVGA

SEQ ID NO: 979 - protein, 9 aa, Artificial Sequence
  HCDR1
GFTISSDYD

SEQ ID NO: 980 - protein, 9 aa, Artificial Sequence
  HCDR2
ILGGSGGST

SEQ ID NO: 981 - protein, 11 aa, Artificial Sequence
  HCDR3
TRASGFTYFEL

SEQ ID NO: 982 - protein, 8 aa, Artificial Sequence
  LCDR1
QSVYNNKN

SEQ ID NO: 983 - protein, 3 aa, Artificial Sequence
  LCDR2
YAS

SEQ ID NO: 984 - protein, 13 aa, Artificial Sequence
  LCDR3
QGEFSCSSSDCFA

SEQ ID NO: 985 - protein, 8 aa, Artificial Sequence
  HCDR1
GFDLSSYA

SEQ ID NO: 986 - protein, 8 aa, Artificial Sequence
  HCDR2
IYGGSGST

SEQ ID NO: 987 - protein, 18 aa, Artificial Sequence
  HCDR3
ARAYDSGYIGNSFYAFDP

SEQ ID NO: 988 - protein, 6 aa, Artificial Sequence
  LCDR1
QTISST

SEQ ID NO: 989 - protein, 3 aa, Artificial Sequence
  LCDR2
SAS

SEQ ID NO: 990 - protein, 10 aa, Artificial Sequence
  LCDR3
AGYGTVGVTA

SEQ ID NO: 991 - protein, 8 aa, Artificial Sequence
  HCDR1
GFSLSSYY

SEQ ID NO: 992 - protein, 7 aa, Artificial Sequence
  HCDR2
ISTAGNT

SEQ ID NO: 993 - protein, 14 aa, Artificial Sequence
  HCDR3
TRDGAGDSNYYRNL

SEQ ID NO: 994 - protein, 6 aa, Artificial Sequence
  LCDR1
ESIDRF

SEQ ID NO: 995 - protein, 3 aa, Artificial Sequence
  LCDR2
DAS

SEQ ID NO: 996 - protein, 12 aa, Artificial Sequence
  LCDR3
QQGYAISDIDNV

SEQ ID NO: 997 - protein, 8 aa, Artificial Sequence
  HCDR1
GIDLNNNA

SEQ ID NO: 998 - protein, 7 aa, Artificial Sequence
  HCDR2
ISTADTT

SEQ ID NO: 999 - protein, 13 aa, Artificial Sequence
  HCDR3
ARAAYFSYGYFNL

SEQ ID NO: 1000 - protein, 6 aa, Artificial Sequence
  LCDR1
QNIGNA

SEQ ID NO: 1001 - protein, 3 aa, Artificial Sequence
  LCDR2
GAS

SEQ ID NO: 1002 - protein, 10 aa, Artificial Sequence
  LCDR3
QSYVYSDGNV

SEQ ID NO: 1003 - protein, 9 aa, Artificial Sequence
  HCDR1
GFSFDSNYW

SEQ ID NO: 1004 - protein, 8 aa, Artificial Sequence
  HCDR2
IMTGDGSI

SEQ ID NO: 1005 - protein, 19 aa, Artificial Sequence
  HCDR3
ARGYDGIHGGDNYGHVFNL

SEQ ID NO: 1006 - protein, 6 aa, Artificial Sequence
  LCDR1
ENIYTL

SEQ ID NO: 1007 - protein, 3 aa, Artificial Sequence
  LCDR2
RAS

SEQ ID NO: 1008 - protein, 10 aa, Artificial Sequence
  LCDR3
QGYYVDSGNT

SEQ ID NO: 1009 - protein, 8 aa, Artificial Sequence
  HCDR1
GFSLSSYY

SEQ ID NO: 1010 - protein, 7 aa, Artificial Sequence
  HCDR2
ISTAGNT

SEQ ID NO: 1011 - protein, 14 aa, Artificial Sequence
  HCDR3
ARDGAGDSNYYRNL

SEQ ID NO: 1012 - protein, 6 aa, Artificial Sequence
  LCDR1
ESIDRF

SEQ ID NO: 1013 - protein, 3 aa, Artificial Sequence
  LCDR2
DAS

SEQ ID NO: 1014 - protein, 12 aa, Artificial Sequence
  LCDR3
QQGYSISDIDNV

SEQ ID NO: 1015 - protein, 9 aa, Artificial Sequence
  HCDR1
GLSFSDRYW

SEQ ID NO: 1016 - protein, 9 aa, Artificial Sequence
  HCDR2
IYTGSDGVA

SEQ ID NO: 1017 - protein, 15 aa, Artificial Sequence
  HCDR3
ARDREYGSNTGVYSL

SEQ ID NO: 1018 - protein, 6 aa, Artificial Sequence
  LCDR1
QNIYSN

SEQ ID NO: 1019 - protein, 3 aa, Artificial Sequence
  LCDR2
DAS

SEQ ID NO: 1020 - protein, 11 aa, Artificial Sequence
  LCDR3
QCTYYGNNYIT

SEQ ID NO: 1021 - protein, 8 aa, Artificial Sequence
  HCDR1
GFTLSSYL

SEQ ID NO: 1022 - protein, 8 aa, Artificial Sequence
  HCDR2
IGTYSGAT

SEQ ID NO: 1023 - protein, 8 aa, Artificial Sequence
  HCDR3
ARDYNFAL

SEQ ID NO: 1024 - protein, 8 aa, Artificial Sequence
  LCDR1
ESVYNNNY

SEQ ID NO: 1025 - protein, 3 aa, Artificial Sequence
  LCDR2
GAS

SEQ ID NO: 1026 - protein, 12 aa, Artificial Sequence
  LCDR3
AGYKSSWTDGNA

SEQ ID NO: 1027 - protein, 8 aa, Artificial Sequence
  HCDR1
GFSLNSYV

SEQ ID NO: 1028 - protein, 7 aa, Artificial Sequence
  HCDR2
IDYGGAP

SEQ ID NO: 1029 - protein, 14 aa, Artificial Sequence
  HCDR3
ARGGYGGYVLVTAL

SEQ ID NO: 1030 - protein, 6 aa, Artificial Sequence
  LCDR1
ENIYSY

SEQ ID NO: 1031 - protein, 3 aa, Artificial Sequence
  LCDR2
QAS

SEQ ID NO: 1032 - protein, 12 aa, Artificial Sequence
  LCDR3
QTYYGGSTYGNG

SEQ ID NO: 1033 - protein, 9 aa, Artificial Sequence
  HCDR1
GFTLSSRYY

SEQ ID NO: 1034 - protein, 8 aa, Artificial Sequence
  HCDR2
IYAGSLRT

SEQ ID NO: 1035 - protein, 13 aa, Artificial Sequence
  HCDR3
ARSPGVAASYPEL

SEQ ID NO: 1036 - protein, 8 aa, Artificial Sequence
  LCDR1
QSVGNADN

SEQ ID NO: 1037 - protein, 3 aa, Artificial Sequence
  LCDR2
YAA

SEQ ID NO: 1038 - protein, 13 aa, Artificial Sequence
  LCDR3
GGGYYNSTDTFYT

SEQ ID NO: 1039 - protein, 9 aa, Artificial Sequence
  HCDR1
GFDFSSTYW

SEQ ID NO: 1040 - protein, 8 aa, Artificial Sequence
  HCDR2
IDDSYAYT

SEQ ID NO: 1041 - protein, 15 aa, Artificial Sequence
  HCDR3
ARDGYPGYGVGSFNL

SEQ ID NO: 1042 - protein, 8 aa, Artificial Sequence
  LCDR1
ESVYSNNR

SEQ ID NO: 1043 - protein, 3 aa, Artificial Sequence
  LCDR2
LAS

SEQ ID NO: 1044 - protein, 12 aa, Artificial Sequence
  LCDR3
AGYKSYSDDGTG

SEQ ID NO: 1045 - protein, 8 aa, Artificial Sequence
  HCDR1
GFSLSSYV

SEQ ID NO: 1046 - protein, 7 aa, Artificial Sequence
  HCDR2
IDYGGAP

SEQ ID NO: 1047 - protein, 14 aa, Artificial Sequence
  HCDR3
ARGGYGGYVLVTVL

SEQ ID NO: 1048 - protein, 6 aa, Artificial Sequence
  LCDR1
QNIYSS

SEQ ID NO: 1049 - protein, 3 aa, Artificial Sequence
  LCDR2
QAS

SEQ ID NO: 1050 - protein, 12 aa, Artificial Sequence
  LCDR3
QTYYGGSTYGNG

SEQ ID NO: 1051 - protein, 8 aa, Artificial Sequence
  HCDR1
GFDLSINV

SEQ ID NO: 1052 - protein, 8 aa, Artificial Sequence
  HCDR2
IDNGDGST

SEQ ID NO: 1053 - protein, 19 aa, Artificial Sequence
  HCDR3
ARPGTFTYGGNTYPGSFVL

SEQ ID NO: 1054 - protein, 6 aa, Artificial Sequence
  LCDR1
QSISNA

SEQ ID NO: 1055 - protein, 3 aa, Artificial Sequence
  LCDR2
TAS

SEQ ID NO: 1056 - protein, 11 aa, Artificial Sequence
  LCDR3
QNYYVNIIGIG

SEQ ID NO: 1057 - protein, 8 aa, Artificial Sequence
  HCDR1
GFSLSSYA

SEQ ID NO: 1058 - protein, 7 aa, Artificial Sequence
  HCDR2
IYGSGST

SEQ ID NO: 1059 - protein, 13 aa, Artificial Sequence
  HCDR3
ARSKGYNYNLWNL

SEQ ID NO: 1060 - protein, 6 aa, Artificial Sequence
  LCDR1
QNIYTN

SEQ ID NO: 1061 - protein, 3 aa, Artificial Sequence
  LCDR2
DAS

SEQ ID NO: 1062 - protein, 13 aa, Artificial Sequence
  LCDR3
QTYSYSGSSSANP

SEQ ID NO: 1063 - protein, 8 aa, Artificial Sequence
  HCDR1
GFSLSSYD

SEQ ID NO: 1064 - protein, 7 aa, Artificial Sequence
  HCDR2
IYLTDTT

SEQ ID NO: 1065 - protein, 15 aa, Artificial Sequence
  HCDR3
ARHLDTSSGGFYFNL

SEQ ID NO: 1066 - protein, 8 aa, Artificial Sequence
  LCDR1
QSVYNSKI

SEQ ID NO: 1067 - protein, 3 aa, Artificial Sequence
  LCDR2
DAS

SEQ ID NO: 1068 - protein, 13 aa, Artificial Sequence
  LCDR3
QGEFTCTSADCIA

SEQ ID NO: 1069 - protein, 9 aa, Artificial Sequence
  HCDR1
EFSFSNNYY

SEQ ID NO: 1070 - protein, 8 aa, Artificial Sequence
  HCDR2
IYVHSGTT

SEQ ID NO: 1071 - protein, 14 aa, Artificial Sequence
  HCDR3
ARGRSGYYADAFDT

SEQ ID NO: 1072 - protein, 8 aa, Artificial Sequence
  LCDR1
QSVYNNNN

SEQ ID NO: 1073 - protein, 3 aa, Artificial Sequence
  LCDR2
LAS

SEQ ID NO: 1074 - protein, 12 aa, Artificial Sequence
  LCDR3
QGTDSSSGWEHA

SEQ ID NO: 1075 - protein, 9 aa, Artificial Sequence
  HCDR1
GLDFSSTPY

SEQ ID NO: 1076 - protein, 9 aa, Artificial Sequence
  HCDR2
IYTGSVIYT

SEQ ID NO: 1077 - protein, 17 aa, Artificial Sequence
  HCDR3
ARSPAGYAAYGYGGFNL

SEQ ID NO: 1078 - protein, 6 aa, Artificial Sequence
  LCDR1
QNIYNN

SEQ ID NO: 1079 - protein, 3 aa, Artificial Sequence
  LCDR2
GAS

SEQ ID NO: 1080 - protein, 13 aa, Artificial Sequence
  LCDR3
QSAYYSSSATDMA

SEQ ID NO: 1081 - protein, 8 aa, Artificial Sequence
  HCDR1
GFSLSSYH

SEQ ID NO: 1082 - protein, 8 aa, Artificial Sequence
  HCDR2
IYAGSGNT

SEQ ID NO: 1083 - protein, 15 aa, Artificial Sequence
  HCDR3
ARQPGGGASDTQLDL

SEQ ID NO: 1084 - protein, 8 aa, Artificial Sequence
  LCDR1
QSVFDNNQ

SEQ ID NO: 1085 - protein, 3 aa, Artificial Sequence
  LCDR2
RAS

SEQ ID NO: 1086 - protein, 11 aa, Artificial Sequence
  LCDR3
LGGYSSSSDTV

SEQ ID NO: 1087 - protein, 9 aa, Artificial Sequence
  HCDR1
GFSFSSRFW

SEQ ID NO: 1088 - protein, 9 aa, Artificial Sequence
  HCDR2
IYGGSTSAT

SEQ ID NO: 1089 - protein, 13 aa, Artificial Sequence
  HCDR3
TRLPTYDAYVFNL

SEQ ID NO: 1090 - protein, 8 aa, Artificial Sequence
  LCDR1
ESVFSNNY

SEQ ID NO: 1091 - protein, 3 aa, Artificial Sequence
  LCDR2
EAS

SEQ ID NO: 1092 - protein, 12 aa, Artificial Sequence
  LCDR3
GGYKSNNVDGYA

SEQ ID NO: 1093 - protein, 8 aa, Artificial Sequence
  HCDR1
GFSLNHYH

SEQ ID NO: 1094 - protein, 7 aa, Artificial Sequence
  HCDR2
IDNSGYI

SEQ ID NO: 1095 - protein, 11 aa, Artificial Sequence
  HCDR3
GKYYSGGSYDL

SEQ ID NO: 1096 - protein, 8 aa, Artificial Sequence
  LCDR1
QSVWNNNW

SEQ ID NO: 1097 - protein, 3 aa, Artificial Sequence
  LCDR2
ETS

SEQ ID NO: 1098 - protein, 13 aa, Artificial Sequence
  LCDR3
QGEFSCSSDDCNA

SEQ ID NO: 1099 - protein, 8 aa, Artificial Sequence
  HCDR1
GFSLSGHD

SEQ ID NO: 1100 - protein, 7 aa, Artificial Sequence
  HCDR2
IGSNSKT

SEQ ID NO: 1101 - protein, 14 aa, Artificial Sequence
  HCDR3
TVVGPGVGGFYFDL

SEQ ID NO: 1102 - protein, 6 aa, Artificial Sequence
  LCDR1
QSIGSD

SEQ ID NO: 1103 - protein, 3 aa, Artificial Sequence
  LCDR2
AAS

SEQ ID NO: 1104 - protein, 12 aa, Artificial Sequence
  LCDR3
QCTYVGSTYLGA

SEQ ID NO: 1105 - protein, 8 aa, Artificial Sequence
  HCDR1
GIDLSSYA

SEQ ID NO: 1106 - protein, 7 aa, Artificial Sequence
  HCDR2
ISSSGST

SEQ ID NO: 1107 - protein, 14 aa, Artificial Sequence
  HCDR3
ARDGDSGRGYYFHF

SEQ ID NO: 1108 - protein, 6 aa, Artificial Sequence
  LCDR1
EDIYSL

SEQ ID NO: 1109 - protein, 3 aa, Artificial Sequence
  LCDR2
DAS

SEQ ID NO: 1110 - protein, 13 aa, Artificial Sequence
  LCDR3
QQGYTTVTIVDNV

SEQ ID NO: 1111 - protein, 9 aa, Artificial Sequence
  HCDR1
GFSFSSSYW

SEQ ID NO: 1112 - protein, 8 aa, Artificial Sequence
  HCDR2
MITGRGNT

SEQ ID NO: 1113 - protein, 12 aa, Artificial Sequence
  HCDR3
ARGPGGADPINL

SEQ ID NO: 1114 - protein, 6 aa, Artificial Sequence
  LCDR1
QNIYNN

SEQ ID NO: 1115 - protein, 3 aa, Artificial Sequence
  LCDR2
LAS

SEQ ID NO: 1116 - protein, 13 aa, Artificial Sequence
  LCDR3
QSTYDGSSYVPNA

SEQ ID NO: 1117 - protein, 8 aa, Artificial Sequence
  HCDR1
GIDLSSYA

SEQ ID NO: 1118 - protein, 7 aa, Artificial Sequence
  HCDR2
IYASDRT

SEQ ID NO: 1119 - protein, 16 aa, Artificial Sequence
  HCDR3
GRYGRGSGGYYYGMDL

SEQ ID NO: 1120 - protein, 6 aa, Artificial Sequence
  LCDR1
QSGDNY

SEQ ID NO: 1121 - protein, 3 aa, Artificial Sequence
  LCDR2
LAS

SEQ ID NO: 1122 - protein, 14 aa, Artificial Sequence
  LCDR3
QNYCAGSGVCVGVA

SEQ ID NO: 1123 - protein, 8 aa, Artificial Sequence
  HCDR1
GIDLSSYA

SEQ ID NO: 1124 - protein, 8 aa, Artificial Sequence
  HCDR2
IYGGSGST

SEQ ID NO: 1125 - protein, 18 aa, Artificial Sequence
  HCDR3
ARAYDSGYIGNSFYIFDP

SEQ ID NO: 1126 - protein, 6 aa, Artificial Sequence
  LCDR1
QSISSR

SEQ ID NO: 1127 - protein, 3 aa, Artificial Sequence
  LCDR2
SAS

SEQ ID NO: 1128 - protein, 10 aa, Artificial Sequence
  LCDR3
AGYGGLGITA

SEQ ID NO: 1129 - protein, 8 aa, Artificial Sequence
  HCDR1
GFSLSNYY

SEQ ID NO: 1130 - protein, 7 aa, Artificial Sequence
  HCDR2
ISTAGNT

SEQ ID NO: 1131 - protein, 14 aa, Artificial Sequence
  HCDR3
ARDGAGDSNYYRNL

SEQ ID NO: 1132 - protein, 6 aa, Artificial Sequence
  LCDR1
QSIDRF

SEQ ID NO: 1133 - protein, 3 aa, Artificial Sequence
  LCDR2
DAS

SEQ ID NO: 1134 - protein, 12 aa, Artificial Sequence
  LCDR3
QQGYSISDIDNV

SEQ ID NO: 1135 - protein, 8 aa, Artificial Sequence
  HCDR1
GFSLSSHA

SEQ ID NO: 1136 - protein, 7 aa, Artificial Sequence
  HCDR2
IDTDASA

SEQ ID NO: 1137 - protein, 16 aa, Artificial Sequence
  HCDR3
ARDGGYTDYSYYAMDL

SEQ ID NO: 1138 - protein, 6 aa, Artificial Sequence
  LCDR1
ETIYVN

SEQ ID NO: 1139 - protein, 3 aa, Artificial Sequence
  LCDR2
RAS

SEQ ID NO: 1140 - protein, 12 aa, Artificial Sequence
  LCDR3
HQAYRRSDVGNI

SEQ ID NO: 1141 - protein, 8 aa, Artificial Sequence
  HCDR1
GFSLSSYD

SEQ ID NO: 1142 - protein, 7 aa, Artificial Sequence
  HCDR2
ITTDGGT

SEQ ID NO: 1143 - protein, 9 aa, Artificial Sequence
  HCDR3
ARGYASFNL

SEQ ID NO: 1144 - protein, 8 aa, Artificial Sequence
  LCDR1
QSVLSNSY

SEQ ID NO: 1145 - protein, 3 aa, Artificial Sequence
  LCDR2
AAS

SEQ ID NO: 1146 - protein, 12 aa, Artificial Sequence
  LCDR3
QGTDYSGGWYVA

SEQ ID NO: 1147 - protein, 8 aa, Artificial Sequence
  HCDR1
GIDLSSYA

SEQ ID NO: 1148 - protein, 7 aa, Artificial Sequence
  HCDR2
IYTTNRT

SEQ ID NO: 1149 - protein, 16 aa, Artificial Sequence
  HCDR3
GRYGRGSGGYYYGMDL

SEQ ID NO: 1150 - protein, 6 aa, Artificial Sequence
  LCDR1
QSGDNY

SEQ ID NO: 1151 - protein, 3 aa, Artificial Sequence
  LCDR2
QAS

SEQ ID NO: 1152 - protein, 14 aa, Artificial Sequence
  LCDR3
QNYCAGSGVCLGIA

SEQ ID NO: 1153 - protein, 8 aa, Artificial Sequence
  HCDR1
GFDFSSDA

SEQ ID NO: 1154 - protein, 9 aa, Artificial Sequence
  HCDR2
IYVGSVGSS

SEQ ID NO: 1155 - protein, 11 aa, Artificial Sequence
  HCDR3
ARGENIAYFTF

SEQ ID NO: 1156 - protein, 6 aa, Artificial Sequence
  LCDR1
QSINSW

SEQ ID NO: 1157 - protein, 3 aa, Artificial Sequence
  LCDR2
KAS

SEQ ID NO: 1158 - protein, 15 aa, Artificial Sequence
  LCDR3
QGYYYYSSSNFASNA

SEQ ID NO: 1159 - protein, 8 aa, Artificial Sequence
  HCDR1
GLSLSSYD

SEQ ID NO: 1160 - protein, 7 aa, Artificial Sequence
  HCDR2
IWSGGST

SEQ ID NO: 1161 - protein, 9 aa, Artificial Sequence
  HCDR3
ARGYVEFDL

SEQ ID NO: 1162 - protein, 8 aa, Artificial Sequence
  LCDR1
QSLYSNNY

SEQ ID NO: 1163 - protein, 3 aa, Artificial Sequence
  LCDR2
PAS

SEQ ID NO: 1164 - protein, 12 aa, Artificial Sequence
  LCDR3
QGTFYDSGWLSA

SEQ ID NO: 1165 - protein, 8 aa, Artificial Sequence
  HCDR1
GFSLNSYY

SEQ ID NO: 1166 - protein, 7 aa, Artificial Sequence
  HCDR2
INGYDNT

SEQ ID NO: 1167 - protein, 15 aa, Artificial Sequence
  HCDR3
ARDPGGASGTGRLDL

SEQ ID NO: 1168 - protein, 6 aa, Artificial Sequence
  LCDR1
QSISTA

SEQ ID NO: 1169 - protein, 3 aa, Artificial Sequence
  LCDR2
DAS

SEQ ID NO: 1170 - protein, 12 aa, Artificial Sequence
  LCDR3
QCTYYDAYDVGA

SEQ ID NO: 1171 - protein, 8 aa, Artificial Sequence
  HCDR1
GIDLSSYW

SEQ ID NO: 1172 - protein, 8 aa, Artificial Sequence
  HCDR2
IATYSSVT

SEQ ID NO: 1173 - protein, 14 aa, Artificial Sequence
  HCDR3
ARDPYSFNGSLFTL

SEQ ID NO: 1174 - protein, 6 aa, Artificial Sequence
  LCDR1
QNIGTY

SEQ ID NO: 1175 - protein, 3 aa, Artificial Sequence
  LCDR2
TAS

SEQ ID NO: 1176 - protein, 12 aa, Artificial Sequence
  LCDR3
AGYKNYNNDDNG

SEQ ID NO: 1177 - protein, 8 aa, Artificial Sequence
  HCDR1
GFSLNNYD

SEQ ID NO: 1178 - protein, 7 aa, Artificial Sequence
  HCDR2
IDTGGSA

SEQ ID NO: 1179 - protein, 9 aa, Artificial Sequence
  HCDR3
ARGYIHGYL

SEQ ID NO: 1180 - protein, 6 aa, Artificial Sequence
  LCDR1
QNVYNN

SEQ ID NO: 1181 - protein, 3 aa, Artificial Sequence
  LCDR2
SAS

SEQ ID NO: 1182 - protein, 13 aa, Artificial Sequence
  LCDR3
QSADWESSNFFWA

SEQ ID NO: 1183 - protein, 8 aa, Artificial Sequence
  HCDR1
GFSLSSYG

SEQ ID NO: 1184 - protein, 7 aa, Artificial Sequence
  HCDR2
IIDVTYT

SEQ ID NO: 1185 - protein, 14 aa, Artificial Sequence
  HCDR3
ARTPGYGIYAYGNL

SEQ ID NO: 1186 - protein, 8 aa, Artificial Sequence
  LCDR1
QSVYGNNW

SEQ ID NO: 1187 - protein, 3 aa, Artificial Sequence
  LCDR2
YAS

SEQ ID NO: 1188 - protein, 10 aa, Artificial Sequence
  LCDR3
QGYYSSAAYV

SEQ ID NO: 1189 - protein, 8 aa, Artificial Sequence
  HCDR1
GFSLSTYV

SEQ ID NO: 1190 - protein, 7 aa, Artificial Sequence
  HCDR2
IYGGGTI

SEQ ID NO: 1191 - protein, 14 aa, Artificial Sequence
  HCDR3
ARDGSSSGDPGFNL

SEQ ID NO: 1192 - protein, 6 aa, Artificial Sequence
  LCDR1
QSISNW

SEQ ID NO: 1193 - protein, 3 aa, Artificial Sequence
  LCDR2
KAS

SEQ ID NO: 1194 - protein, 11 aa, Artificial Sequence
  LCDR3
QSTGSTAYGRA

SEQ ID NO: 1195 - protein, 8 aa, Artificial Sequence
  HCDR1
GFSLSHYH

SEQ ID NO: 1196 - protein, 7 aa, Artificial Sequence
  HCDR2
TLNNGRI

SEQ ID NO: 1197 - protein, 11 aa, Artificial Sequence
  HCDR3
AKYFVSESYDL

SEQ ID NO: 1198 - protein, 8 aa, Artificial Sequence
  LCDR1
QSVYNDNW

SEQ ID NO: 1199 - protein, 3 aa, Artificial Sequence
  LCDR2
GAS

SEQ ID NO: 1200 - protein, 11 aa, Artificial Sequence
  LCDR3
LGGYKDNSDNV

SEQ ID NO: 1201 - protein, 8 aa, Artificial Sequence
  HCDR1
GIDLSSYD

SEQ ID NO: 1202 - protein, 7 aa, Artificial Sequence
  HCDR2
ISTGGDT

SEQ ID NO: 1203 - protein, 9 aa, Artificial Sequence
  HCDR3
ARGYYTLAL

SEQ ID NO: 1204 - protein, 6 aa, Artificial Sequence
  LCDR1
QSINSW

SEQ ID NO: 1205 - protein, 3 aa, Artificial Sequence
  LCDR2
DTS

SEQ ID NO: 1206 - protein, 13 aa, Artificial Sequence
  LCDR3
QSYYYITSSYAIT

SEQ ID NO: 1207 - protein, 8 aa, Artificial Sequence
  HCDR1
GSDISGYA

SEQ ID NO: 1208 - protein, 7 aa, Artificial Sequence
  HCDR2
IAADGNA

SEQ ID NO: 1209 - protein, 16 aa, Artificial Sequence
  HCDR3
ARGYSSGWGTYGYFDL

SEQ ID NO: 1210 - protein, 6 aa, Artificial Sequence
  LCDR1
EDIYSY

SEQ ID NO: 1211 - protein, 3 aa, Artificial Sequence
  LCDR2
RAS

SEQ ID NO: 1212 - protein, 14 aa, Artificial Sequence
  LCDR3
QSYYYSHSTTYSNV

SEQ ID NO: 1213 - protein, 8 aa, Artificial Sequence
  HCDR1
GFSLSTYA

SEQ ID NO: 1214 - protein, 7 aa, Artificial Sequence
  HCDR2
NTRSGII

SEQ ID NO: 1215 - protein, 15 aa, Artificial Sequence
  HCDR3
ARDLYADVSGYYLGL

SEQ ID NO: 1216 - protein, 8 aa, Artificial Sequence
  LCDR1
QSLYNNKN

SEQ ID NO: 1217 - protein, 3 aa, Artificial Sequence
  LCDR2
YAS

SEQ ID NO: 1218 - protein, 13 aa, Artificial Sequence
  LCDR3
QGEFICSSADCVV

SEQ ID NO: 1219 - protein, 8 aa, Artificial Sequence
  HCDR1
GFSLSYYY

SEQ ID NO: 1220 - protein, 7 aa, Artificial Sequence
  HCDR2
TGGGGDT

SEQ ID NO: 1221 - protein, 14 aa, Artificial Sequence
  HCDR3
ARGTDGAAHTGFAL

SEQ ID NO: 1222 - protein, 6 aa, Artificial Sequence
  LCDR1
EDISSR

SEQ ID NO: 1223 - protein, 3 aa, Artificial Sequence
  LCDR2
LAS

SEQ ID NO: 1224 - protein, 13 aa, Artificial Sequence
  LCDR3
QSSSYGTSTIYGT

SEQ ID NO: 1225 - protein, 8 aa, Artificial Sequence
  HCDR1
GFSLSNFY

SEQ ID NO: 1226 - protein, 7 aa, Artificial Sequence
  HCDR2
ISTGGSA

SEQ ID NO: 1227 - protein, 17 aa, Artificial Sequence
  HCDR3
ARGSGTDGAWLYYGIDL

SEQ ID NO: 1228 - protein, 6 aa, Artificial Sequence
  LCDR1
ENIGHA

SEQ ID NO: 1229 - protein, 3 aa, Artificial Sequence
  LCDR2
RTS

SEQ ID NO: 1230 - protein, 13 aa, Artificial Sequence
  LCDR3
QINYGGGSGGYFA

SEQ ID NO: 1231 - protein, 9 aa, Artificial Sequence
  HCDR1
GFSFSSSYY

SEQ ID NO: 1232 - protein, 7 aa, Artificial Sequence
  HCDR2
YTYSGDT

SEQ ID NO: 1233 - protein, 15 aa, Artificial Sequence
  HCDR3
AKAGYGGYGYPIFNL

SEQ ID NO: 1234 - protein, 6 aa, Artificial Sequence
  LCDR1
QSIGSS

SEQ ID NO: 1235 - protein, 3 aa, Artificial Sequence
  LCDR2
YVS

SEQ ID NO: 1236 - protein, 13 aa, Artificial Sequence
  LCDR3
QSYYGSGTTVFWA

SEQ ID NO: 1237 - protein, 8 aa, Artificial Sequence
  HCDR1
GFSLSSYA

SEQ ID NO: 1238 - protein, 7 aa, Artificial Sequence
  HCDR2
IWSGGTT

SEQ ID NO: 1239 - protein, 18 aa, Artificial Sequence
  HCDR3
ARGLGDRGSSDYYMPLKL

SEQ ID NO: 1240 - protein, 6 aa, Artificial Sequence
  LCDR1
EDIESY

SEQ ID NO: 1241 - protein, 3 aa, Artificial Sequence
  LCDR2
STS

SEQ ID NO: 1242 - protein, 13 aa, Artificial Sequence
  LCDR3
QCTYDGSSAVWGA

SEQ ID NO: 1243 - protein, 8 aa, Artificial Sequence
  HCDR1
GFSLSSYY

SEQ ID NO: 1244 - protein, 7 aa, Artificial Sequence
  HCDR2
ISTGGSA

SEQ ID NO: 1245 - protein, 9 aa, Artificial Sequence
  HCDR3
ARGWRYEDL

SEQ ID NO: 1246 - protein, 8 aa, Artificial Sequence
  LCDR1
QTVYNNNY

SEQ ID NO: 1247 - protein, 3 aa, Artificial Sequence
  LCDR2
DAS

SEQ ID NO: 1248 - protein, 12 aa, Artificial Sequence
  LCDR3
QGTYYDNAWYHT

SEQ ID NO: 1249 - protein, 8 aa, Artificial Sequence
  HCDR1
GIDLSSYV

SEQ ID NO: 1250 - protein, 7 aa, Artificial Sequence
  HCDR2
IDYGGTA

SEQ ID NO: 1251 - protein, 14 aa, Artificial Sequence
  HCDR3
ARGGYGGYTLVTAL

SEQ ID NO: 1252 - protein, 6 aa, Artificial Sequence
  LCDR1
QSISSY

SEQ ID NO: 1253 - protein, 3 aa, Artificial Sequence
  LCDR2
STS

SEQ ID NO: 1254 - protein, 12 aa, Artificial Sequence
  LCDR3
QTYYGGGPFGNG

SEQ ID NO: 1255 - protein, 8 aa, Artificial Sequence
  HCDR1
GFSLSSYG

SEQ ID NO: 1256 - protein, 7 aa, Artificial Sequence
  HCDR2
ISSNDNK

SEQ ID NO: 1257 - protein, 14 aa, Artificial Sequence
  HCDR3
VRNGVYNTGNYFDL

SEQ ID NO: 1258 - protein, 8 aa, Artificial Sequence
  LCDR1
QSLYNNKN

SEQ ID NO: 1259 - protein, 3 aa, Artificial Sequence
  LCDR2
TAS

SEQ ID NO: 1260 - protein, 13 aa, Artificial Sequence
  LCDR3
QGEFDCDSDDCFA

SEQ ID NO: 1261 - protein, 8 aa, Artificial Sequence
  HCDR1
GFSLSTYA

SEQ ID NO: 1262 - protein, 7 aa, Artificial Sequence
  HCDR2
IYTGGST

SEQ ID NO: 1263 - protein, 13 aa, Artificial Sequence
  HCDR3
TRDLGATYDYFDL

SEQ ID NO: 1264 - protein, 6 aa, Artificial Sequence
  LCDR1
QSISTA

SEQ ID NO: 1265 - protein, 3 aa, Artificial Sequence
  LCDR2
DTS

SEQ ID NO: 1266 - protein, 12 aa, Artificial Sequence
  LCDR3
QQGYRHTNVDNP

SEQ ID NO: 1267 - protein, 8 aa, Artificial Sequence
  HCDR1
GFSLSKYD

SEQ ID NO: 1268 - protein, 7 aa, Artificial Sequence
  HCDR2
IGASDRT

SEQ ID NO: 1269 - protein, 14 aa, Artificial Sequence
  HCDR3
AREYPDARGYYYNL

SEQ ID NO: 1270 - protein, 6 aa, Artificial Sequence
  LCDR1
QSISDL

SEQ ID NO: 1271 - protein, 3 aa, Artificial Sequence
  LCDR2
DAS

SEQ ID NO: 1272 - protein, 12 aa, Artificial Sequence
  LCDR3
QQGYSITNVDNV

SEQ ID NO: 1273 - protein, 8 aa, Artificial Sequence
  HCDR1
GFSLSSNA

SEQ ID NO: 1274 - protein, 7 aa, Artificial Sequence
  HCDR2
ITHSDNT

SEQ ID NO: 1275 - protein, 19 aa, Artificial Sequence
  HCDR3
ARDGYVSSSGTYMGGYFDL

SEQ ID NO: 1276 - protein, 8 aa, Artificial Sequence
  LCDR1
QIIYNDKN

SEQ ID NO: 1277 - protein, 3 aa, Artificial Sequence
  LCDR2
YAS

SEQ ID NO: 1278 - protein, 13 aa, Artificial Sequence
  LCDR3
QGEFSCSSADCIA

SEQ ID NO: 1279 - protein, 8 aa, Artificial Sequence
  HCDR1
GIDLSSYA

SEQ ID NO: 1280 - protein, 7 aa, Artificial Sequence
  HCDR2
IGAGGST

SEQ ID NO: 1281 - protein, 16 aa, Artificial Sequence
  HCDR3
ARDIGGDYSSRYYFSL

SEQ ID NO: 1282 - protein, 6 aa, Artificial Sequence
  LCDR1
QSTSTA

SEQ ID NO: 1283 - protein, 3 aa, Artificial Sequence
  LCDR2
DSS

SEQ ID NO: 1284 - protein, 10 aa, Artificial Sequence
  LCDR3
QQGYNINNVA

SEQ ID NO: 1285 - protein, 8 aa, Artificial Sequence
  HCDR1
GFTISSHH

SEQ ID NO: 1286 - protein, 7 aa, Artificial Sequence
  HCDR2
IFPSGHT

SEQ ID NO: 1287 - protein, 9 aa, Artificial Sequence
  HCDR3
VRDVGYFTL

SEQ ID NO: 1288 - protein, 8 aa, Artificial Sequence
  LCDR1
ESVGGNNW

SEQ ID NO: 1289 - protein, 3 aa, Artificial Sequence
  LCDR2
GAS

SEQ ID NO: 1290 - protein, 10 aa, Artificial Sequence
  LCDR3
QGYYSDVTNA

SEQ ID NO: 1291 - protein, 8 aa, Artificial Sequence
  HCDR1
GFSLSSYY

SEQ ID NO: 1292 - protein, 9 aa, Artificial Sequence
  HCDR2
ITSGGSGST

SEQ ID NO: 1293 - protein, 13 aa, Artificial Sequence
  HCDR3
ARYGDSFYWALDL

SEQ ID NO: 1294 - protein, 7 aa, Artificial Sequence
  LCDR1
QSVLNND

SEQ ID NO: 1295 - protein, 3 aa, Artificial Sequence
  LCDR2
AAS

SEQ ID NO: 1296 - protein, 10 aa, Artificial Sequence
  LCDR3
QGYFIDVNNP

SEQ ID NO: 1297 - protein, 8 aa, Artificial Sequence
  HCDR1
GIDLSRYD

SEQ ID NO: 1298 - protein, 7 aa, Artificial Sequence
  HCDR2
IGASGST

SEQ ID NO: 1299 - protein, 14 aa, Artificial Sequence
  HCDR3
AREETDSRGYYYSL

SEQ ID NO: 1300 - protein, 6 aa, Artificial Sequence
  LCDR1
QSISDL

SEQ ID NO: 1301 - protein, 3 aa, Artificial Sequence
  LCDR2
DAS

SEQ ID NO: 1302 - protein, 12 aa, Artificial Sequence
  LCDR3
QQGYSINNVDNA

SEQ ID NO: 1303 - protein, 8 aa, Artificial Sequence
  HCDR1
GFSLSSYG

SEQ ID NO: 1304 - protein, 7 aa, Artificial Sequence
  HCDR2
SSSNDNT

SEQ ID NO: 1305 - protein, 14 aa, Artificial Sequence
  HCDR3
ARNGVYSTGNYFDL

SEQ ID NO: 1306 - protein, 8 aa, Artificial Sequence
  LCDR1
QSVYNNNN

SEQ ID NO: 1307 - protein, 3 aa, Artificial Sequence
  LCDR2
AAS

SEQ ID NO: 1308 - protein, 13 aa, Artificial Sequence
  LCDR3
QGEFDCDSADCFA

SEQ ID NO: 1309 - protein, 9 aa, Artificial Sequence
  HCDR1
GFSFSSNYC

SEQ ID NO: 1310 - protein, 9 aa, Artificial Sequence
  HCDR2
ICAGASGAT

SEQ ID NO: 1311 - protein, 13 aa, Artificial Sequence
  HCDR3
ARYDNSGWGDFKL

SEQ ID NO: 1312 - protein, 6 aa, Artificial Sequence
  LCDR1
QNIGTY

SEQ ID NO: 1313 - protein, 3 aa, Artificial Sequence
  LCDR2
AAS

SEQ ID NO: 1314 - protein, 13 aa, Artificial Sequence
  LCDR3
QNTYYDSPVVGGA

SEQ ID NO: 1315 - protein, 8 aa, Artificial Sequence
  HCDR1
GIDLSSYA

SEQ ID NO: 1316 - protein, 7 aa, Artificial Sequence
  HCDR2
ISTGGST

SEQ ID NO: 1317 - protein, 15 aa, Artificial Sequence
  HCDR3
ARDVGGTTVPYYFDL

SEQ ID NO: 1318 - protein, 6 aa, Artificial Sequence
  LCDR1
ESISSW

SEQ ID NO: 1319 - protein, 3 aa, Artificial Sequence
  LCDR2
EAS

SEQ ID NO: 1320 - protein, 12 aa, Artificial Sequence
  LCDR3
QQGYGSSDVHNI

SEQ ID NO: 1321 - protein, 8 aa, Artificial Sequence
  HCDR1
GFSLSNYH

SEQ ID NO: 1322 - protein, 8 aa, Artificial Sequence
  HCDR2
IYAGSDST

SEQ ID NO: 1323 - protein, 15 aa, Artificial Sequence
  HCDR3
ARQPGGGASDTQLDL

SEQ ID NO: 1324 - protein, 8 aa, Artificial Sequence
  LCDR1
QNIFDNNQ

SEQ ID NO: 1325 - protein, 3 aa, Artificial Sequence
  LCDR2
RAS

SEQ ID NO: 1326 - protein, 11 aa, Artificial Sequence
  LCDR3
LGGYSSSSDTV

SEQ ID NO: 1327 - protein, 8 aa, Artificial Sequence
  HCDR1
GFSLSSNA

SEQ ID NO: 1328 - protein, 7 aa, Artificial Sequence
  HCDR2
IDTGGSA

SEQ ID NO: 1329 - protein, 13 aa, Artificial Sequence
  HCDR3
ARDRYTDSSGYNL

SEQ ID NO: 1330 - protein, 6 aa, Artificial Sequence
  LCDR1
QSIGAS

SEQ ID NO: 1331 - protein, 3 aa, Artificial Sequence
  LCDR2
SAS

SEQ ID NO: 1332 - protein, 14 aa, Artificial Sequence
  LCDR3
QSYYYRSSSGYGYA

SEQ ID NO: 1333 - protein, 8 aa, Artificial Sequence
  HCDR1
GFSLSSYV

SEQ ID NO: 1334 - protein, 7 aa, Artificial Sequence
  HCDR2
SDYGGTA

SEQ ID NO: 1335 - protein, 14 aa, Artificial Sequence
  HCDR3
ARGGYDGYLLVTGL

SEQ ID NO: 1336 - protein, 6 aa, Artificial Sequence
  LCDR1
QSISSY

SEQ ID NO: 1337 - protein, 3 aa, Artificial Sequence
  LCDR2
SAS

SEQ ID NO: 1338 - protein, 12 aa, Artificial Sequence
  LCDR3
QTYYGGGPFGNG

SEQ ID NO: 1339 - protein, 8 aa, Artificial Sequence
  HCDR1
GIDLTSYA

SEQ ID NO: 1340 - protein, 7 aa, Artificial Sequence
  HCDR2
IGSGGGI

SEQ ID NO: 1341 - protein, 11 aa, Artificial Sequence
  HCDR3
ARVPQWAYLDL

SEQ ID NO: 1342 - protein, 8 aa, Artificial Sequence
  LCDR1
ESVYKNNY

SEQ ID NO: 1343 - protein, 3 aa, Artificial Sequence
  LCDR2
DAS

SEQ ID NO: 1344 - protein, 10 aa, Artificial Sequence
  LCDR3
QGYYGGGIFT

SEQ ID NO: 1345 - protein, 8 aa, Artificial Sequence
  HCDR1
GIDLSSYA

SEQ ID NO: 1346 - protein, 7 aa, Artificial Sequence
  HCDR2
ISTISNT

SEQ ID NO: 1347 - protein, 14 aa, Artificial Sequence
  HCDR3
ARGASNTINDYFNL

SEQ ID NO: 1348 - protein, 6 aa, Artificial Sequence
  LCDR1
QSVGNY

SEQ ID NO: 1349 - protein, 3 aa, Artificial Sequence
  LCDR2
DAS

SEQ ID NO: 1350 - protein, 13 aa, Artificial Sequence
  LCDR3
HSYVYSSGNVYNG

SEQ ID NO: 1351 - protein, 8 aa, Artificial Sequence
  HCDR1
GIDLSSNV

SEQ ID NO: 1352 - protein, 7 aa, Artificial Sequence
  HCDR2
IYASATT

SEQ ID NO: 1353 - protein, 14 aa, Artificial Sequence
  HCDR3
ARERLASRGDYSDL

SEQ ID NO: 1354 - protein, 6 aa, Artificial Sequence
  LCDR1
ESIGDL

SEQ ID NO: 1355 - protein, 3 aa, Artificial Sequence
  LCDR2
DAS

SEQ ID NO: 1356 - protein, 13 aa, Artificial Sequence
  LCDR3
QQGYTTTSNVDNI

SEQ ID NO: 1357 - protein, 8 aa, Artificial Sequence
  HCDR1
GFSLSGYH

SEQ ID NO: 1358 - protein, 7 aa, Artificial Sequence
  HCDR2
IGSNGNT

SEQ ID NO: 1359 - protein, 12 aa, Artificial Sequence
  HCDR3
ARSSGWGARFNL

SEQ ID NO: 1360 - protein, 8 aa, Artificial Sequence
  LCDR1
QSIYNDNE

SEQ ID NO: 1361 - protein, 3 aa, Artificial Sequence
  LCDR2
KAS

SEQ ID NO: 1362 - protein, 11 aa, Artificial Sequence
  LCDR3
LGGGMTPSDTT

SEQ ID NO: 1363 - protein, 8 aa, Artificial Sequence
  HCDR1
GFSLSSYY

SEQ ID NO: 1364 - protein, 7 aa, Artificial Sequence
  HCDR2
IDRAGTT

SEQ ID NO: 1365 - protein, 16 aa, Artificial Sequence
  HCDR3
ARNFIYGVGTYYGSDL

SEQ ID NO: 1366 - protein, 6 aa, Artificial Sequence
  LCDR1
ESISRR

SEQ ID NO: 1367 - protein, 3 aa, Artificial Sequence
  LCDR2
GAS

SEQ ID NO: 1368 - protein, 12 aa, Artificial Sequence
  LCDR3
QDTDYGSGHLGA

SEQ ID NO: 1369 - protein, 8 aa, Artificial Sequence
  HCDR1
GFSLSSHG

SEQ ID NO: 1370 - protein, 8 aa, Artificial Sequence
  HCDR2
IYVISGHA

SEQ ID NO: 1371 - protein, 18 aa, Artificial Sequence
  HCDR3
ARGNYGSDSGPNFTRLDL

SEQ ID NO: 1372 - protein, 8 aa, Artificial Sequence
  LCDR1
QSLYNNDY

SEQ ID NO: 1373 - protein, 3 aa, Artificial Sequence
  LCDR2
LAS

SEQ ID NO: 1374 - protein, 13 aa, Artificial Sequence
  LCDR3
QGEFSCSSGDCLA

SEQ ID NO: 1375 - protein, 8 aa, Artificial Sequence
  HCDR1
GFSLSSYD

SEQ ID NO: 1376 - protein, 7 aa, Artificial Sequence
  HCDR2
ISSSGST

SEQ ID NO: 1377 - protein, 9 aa, Artificial Sequence
  HCDR3
ARTSLDGNL

SEQ ID NO: 1378 - protein, 6 aa, Artificial Sequence
  LCDR1
QSIYNY

SEQ ID NO: 1379 - protein, 3 aa, Artificial Sequence
  LCDR2
DAS

SEQ ID NO: 1380 - protein, 12 aa, Artificial Sequence
  LCDR3
QQDYSVSDVDNS

SEQ ID NO: 1381 - protein, 8 aa, Artificial Sequence
  HCDR1
GFSLSSSH

SEQ ID NO: 1382 - protein, 7 aa, Artificial Sequence
  HCDR2
INIGDIA

SEQ ID NO: 1383 - protein, 14 aa, Artificial Sequence
  HCDR3
ARENAYGTGWDFDL

SEQ ID NO: 1384 - protein, 6 aa, Artificial Sequence
  LCDR1
ESIRNA

SEQ ID NO: 1385 - protein, 3 aa, Artificial Sequence
  LCDR2
SAS

SEQ ID NO: 1386 - protein, 12 aa, Artificial Sequence
  LCDR3
QQGFSLRNVDNA

SEQ ID NO: 1387 - protein, 8 aa, Artificial Sequence
  HCDR1
GFSLSNYA

SEQ ID NO: 1388 - protein, 7 aa, Artificial Sequence
  HCDR2
IYTSGTT

SEQ ID NO: 1389 - protein, 17 aa, Artificial Sequence
  HCDR3
ARSRYYGSGWGGYYFNL

SEQ ID NO: 1390 - protein, 6 aa, Artificial Sequence
  LCDR1
EDIYSL

SEQ ID NO: 1391 - protein, 3 aa, Artificial Sequence
  LCDR2
GAS

SEQ ID NO: 1392 - protein, 13 aa, Artificial Sequence
  LCDR3
HGGTYTGSADINA

SEQ ID NO: 1393 - protein, 8 aa, Artificial Sequence
  HCDR1
GIDLSNYA

SEQ ID NO: 1394 - protein, 7 aa, Artificial Sequence
  HCDR2
IGIGGNT

SEQ ID NO: 1395 - protein, 14 aa, Artificial Sequence
  HCDR3
ARHAGAGVVNWLDL

SEQ ID NO: 1396 - protein, 6 aa, Artificial Sequence
  LCDR1
QSIGSN

SEQ ID NO: 1397 - protein, 3 aa, Artificial Sequence
  LCDR2
AAS

SEQ ID NO: 1398 - protein, 13 aa, Artificial Sequence
  LCDR3
QTYGSGSFSSFNL

SEQ ID NO: 1399 - protein, 8 aa, Artificial Sequence
  HCDR1
GFSLSSYY

SEQ ID NO: 1400 - protein, 7 aa, Artificial Sequence
  HCDR2
INTSGGA

SEQ ID NO: 1401 - protein, 13 aa, Artificial Sequence
  HCDR3
ARYLDNGFYCPDL

SEQ ID NO: 1402 - protein, 6 aa, Artificial Sequence
  LCDR1
EDIYTL

SEQ ID NO: 1403 - protein, 3 aa, Artificial Sequence
  LCDR2
KAS

SEQ ID NO: 1404 - protein, 12 aa, Artificial Sequence
  LCDR3
QSTYYGAAYIGA

SEQ ID NO: 1405 - protein, 9 aa, Artificial Sequence
  HCDR1
GVSLSGYYA

SEQ ID NO: 1406 - protein, 7 aa, Artificial Sequence
  HCDR2
LDATGST

SEQ ID NO: 1407 - protein, 14 aa, Artificial Sequence
  HCDR3
ARGSYDGVGYNWGL

SEQ ID NO: 1408 - protein, 6 aa, Artificial Sequence
  LCDR1
ESIYNG

SEQ ID NO: 1409 - protein, 3 aa, Artificial Sequence
  LCDR2
GAS

SEQ ID NO: 1410 - protein, 13 aa, Artificial Sequence
  LCDR3
QSNYGSGSRSNYI

SEQ ID NO: 1411 - protein, 8 aa, Artificial Sequence
  HCDR1
GIDLNNNA

SEQ ID NO: 1412 - protein, 7 aa, Artificial Sequence
  HCDR2
ISTADTT

SEQ ID NO: 1413 - protein, 13 aa, Artificial Sequence
  HCDR3
ARAAYFSYGYFNL

SEQ ID NO: 1414 - protein, 6 aa, Artificial Sequence
  LCDR1
QNIGNA

SEQ ID NO: 1415 - protein, 3 aa, Artificial Sequence
  LCDR2
GAS

SEQ ID NO: 1416 - protein, 10 aa, Artificial Sequence
  LCDR3
QSYVYSDGNV

SEQ ID NO: 1417 - protein, 9 aa, Artificial Sequence
  HCDR1
GIDFSTNYR

SEQ ID NO: 1418 - protein, 9 aa, Artificial Sequence
  HCDR2
IDTDDSDST

SEQ ID NO: 1419 - protein, 15 aa, Artificial Sequence
  HCDR3
TRAYTTSDYAWSFYL

SEQ ID NO: 1420 - protein, 6 aa, Artificial Sequence
  LCDR1
QSISKF

SEQ ID NO: 1421 - protein, 3 aa, Artificial Sequence
  LCDR2
RAS

SEQ ID NO: 1422 - protein, 13 aa, Artificial Sequence
  LCDR3
QCTYGGTSGSVWA

SEQ ID NO: 1423 - protein, 9 aa, Artificial Sequence
  HCDR1
GFSFSSSFY

SEQ ID NO: 1424 - protein, 9 aa, Artificial Sequence
  HCDR2
IYAEDSDYT

SEQ ID NO: 1425 - protein, 15 aa, Artificial Sequence
  HCDR3
AREILYPTNTDSFDL

SEQ ID NO: 1426 - protein, 6 aa, Artificial Sequence
  LCDR1
ESFSSR

SEQ ID NO: 1427 - protein, 3 aa, Artificial Sequence
  LCDR2
RAS

SEQ ID NO: 1428 - protein, 12 aa, Artificial Sequence
  LCDR3
QAYVGISSGGYA

SEQ ID NO: 1429 - protein, 9 aa, Artificial Sequence
  HCDR1
GFSFSSSYW

SEQ ID NO: 1430 - protein, 9 aa, Artificial Sequence
  HCDR2
ISAPGSGST

SEQ ID NO: 1431 - protein, 14 aa, Artificial Sequence
  HCDR3
ARFYAGGSGDYFDL

SEQ ID NO: 1432 - protein, 6 aa, Artificial Sequence
  LCDR1
QNIGSY

SEQ ID NO: 1433 - protein, 3 aa, Artificial Sequence
  LCDR2
TTS

SEQ ID NO: 1434 - protein, 12 aa, Artificial Sequence
  LCDR3
LGVYGYSSDDVA

SEQ ID NO: 1435 - protein, 8 aa, Artificial Sequence
  HCDR1
GIDLSDYA

SEQ ID NO: 1436 - protein, 7 aa, Artificial Sequence
  HCDR2
INIGGIS

SEQ ID NO: 1437 - protein, 18 aa, Artificial Sequence
  HCDR3
AREGYTTGGGGPYYGMDL

SEQ ID NO: 1438 - protein, 6 aa, Artificial Sequence
  LCDR1
QSIHSW

SEQ ID NO: 1439 - protein, 3 aa, Artificial Sequence
  LCDR2
TAS

SEQ ID NO: 1440 - protein, 12 aa, Artificial Sequence
  LCDR3
QRNSYSDFNNYV

SEQ ID NO: 1441 - protein, 9 aa, Artificial Sequence
  HCDR1
GFSFSSSDY

SEQ ID NO: 1442 - protein, 9 aa, Artificial Sequence
  HCDR2
MYTGSVEHT

SEQ ID NO: 1443 - protein, 17 aa, Artificial Sequence
  HCDR3
ARSPTGYPDYGYGGFSL

SEQ ID NO: 1444 - protein, 6 aa, Artificial Sequence
  LCDR1
QNIYSN

SEQ ID NO: 1445 - protein, 3 aa, Artificial Sequence
  LCDR2
GAS

SEQ ID NO: 1446 - protein, 12 aa, Artificial Sequence
  LCDR3
QSAYYSGGPDMA

SEQ ID NO: 1447 - protein, 8 aa, Artificial Sequence
  HCDR1
GFYLSSHY

SEQ ID NO: 1448 - protein, 7 aa, Artificial Sequence
  HCDR2
IYATGIA

SEQ ID NO: 1449 - protein, 14 aa, Artificial Sequence
  HCDR3
ARYDSQDYYGYGNL

SEQ ID NO: 1450 - protein, 6 aa, Artificial Sequence
  LCDR1
QNIYNN

SEQ ID NO: 1451 - protein, 3 aa, Artificial Sequence
  LCDR2
RAS

SEQ ID NO: 1452 - protein, 12 aa, Artificial Sequence
  LCDR3
QQGYSVHDVYNT

SEQ ID NO: 1453 - protein, 8 aa, Artificial Sequence
  HCDR1
GFSLSGYH

SEQ ID NO: 1454 - protein, 7 aa, Artificial Sequence
  HCDR2
IGSNGVT

SEQ ID NO: 1455 - protein, 12 aa, Artificial Sequence
  HCDR3
ARSSGWGARFNL

SEQ ID NO: 1456 - protein, 8 aa, Artificial Sequence
  LCDR1
QSVYNDNE

SEQ ID NO: 1457 - protein, 3 aa, Artificial Sequence
  LCDR2
KAS

SEQ ID NO: 1458 - protein, 11 aa, Artificial Sequence
  LCDR3
LGGGSTPSDST

SEQ ID NO: 1459 - protein, 8 aa, Artificial Sequence
  HCDR1
GFTISSYH

SEQ ID NO: 1460 - protein, 7 aa, Artificial Sequence
  HCDR2
IGSNGNT

SEQ ID NO: 1461 - protein, 12 aa, Artificial Sequence
  HCDR3
ARSSGWGARFNL

SEQ ID NO: 1462 - protein, 8 aa, Artificial Sequence
  LCDR1
QSVYNDNE

SEQ ID NO: 1463 - protein, 3 aa, Artificial Sequence
  LCDR2
KAS

SEQ ID NO: 1464 - protein, 11 aa, Artificial Sequence
  LCDR3
LGGGSTPSDST

SEQ ID NO: 1465 - protein, 8 aa, Artificial Sequence
  HCDR1
GFSLNNAH

SEQ ID NO: 1466 - protein, 7 aa, Artificial Sequence
  HCDR2
IGASGST

SEQ ID NO: 1467 - protein, 12 aa, Artificial Sequence
  HCDR3
GRTDVGYTTANL

SEQ ID NO: 1468 - protein, 6 aa, Artificial Sequence
  LCDR1
QTISSY

SEQ ID NO: 1469 - protein, 3 aa, Artificial Sequence
  LCDR2
SAS

SEQ ID NO: 1470 - protein, 13 aa, Artificial Sequence
  LCDR3
QAYDTTSGTDLWA

SEQ ID NO: 1471 - protein, 9 aa, Artificial Sequence
  HCDR1
GFSFSSDYD

SEQ ID NO: 1472 - protein, 9 aa, Artificial Sequence
  HCDR2
IIGGSSDST

SEQ ID NO: 1473 - protein, 11 aa, Artificial Sequence
  HCDR3
ARNVGFSYYDL

SEQ ID NO: 1474 - protein, 8 aa, Artificial Sequence
  LCDR1
QSLYNNKN

SEQ ID NO: 1475 - protein, 3 aa, Artificial Sequence
  LCDR2
YAS

SEQ ID NO: 1476 - protein, 13 aa, Artificial Sequence
  LCDR3
QGEFSCSSGDCFA

SEQ ID NO: 1477 - protein, 8 aa, Artificial Sequence
  HCDR1
GIDLSSYA

SEQ ID NO: 1478 - protein, 7 aa, Artificial Sequence
  HCDR2
IYSSGST

SEQ ID NO: 1479 - protein, 14 aa, Artificial Sequence
  HCDR3
ARYSAADHGDKFKL

SEQ ID NO: 1480 - protein, 8 aa, Artificial Sequence
  LCDR1
KNIFDNTR

SEQ ID NO: 1481 - protein, 3 aa, Artificial Sequence
  LCDR2
GAS

SEQ ID NO: 1482 - protein, 11 aa, Artificial Sequence
  LCDR3
LGEYSSDSDTS

SEQ ID NO: 1483 - protein, 8 aa, Artificial Sequence
  HCDR1
GFSLSTYY

SEQ ID NO: 1484 - protein, 7 aa, Artificial Sequence
  HCDR2
IYTSGST

SEQ ID NO: 1485 - protein, 17 aa, Artificial Sequence
  HCDR3
ARSRVPGDTTGLYYFNL

SEQ ID NO: 1486 - protein, 6 aa, Artificial Sequence
  LCDR1
ENIYSN

SEQ ID NO: 1487 - protein, 3 aa, Artificial Sequence
  LCDR2
HTS

SEQ ID NO: 1488 - protein, 13 aa, Artificial Sequence
  LCDR3
QSAYDSSSSDTFT

SEQ ID NO: 1489 - protein, 119 aa, Artificial Sequence
  VH
QSVEESGGRLVTPGTPLTLTCTVSGFSLSSYAMSWVRQAPGKGLEWIGIISSSGVTYYASWAKGRFTISKTSTTVDLRITGPTTEDTATYFCARDPGYSTGWDYFFRLWGQGTLVTVSS

SEQ ID NO: 1490 - protein, 112 aa, Artificial Sequence
  VL
AIKMTQTPASVSAAVGGTVSINCQASEDIESYLAWYQQKPGQPPKLLIYDASDLPSGVPSRFKGSGSGKQFTLTISGVQSDDAATYYCQHGAYTSSSDFFYAFGGGTEVVVK

SEQ ID NO: 1491 - protein, 112 aa, Artificial Sequence
  VH
QSVEESGGRLVTPGTPLTLTCTASGFSLSRYYMSWVRQAPGKGLEWIGFINTAGSAYYASWAKGRFTISRTSTTVDLKMTSLTTEDTATYFCARDLSRFSLWGRGTLVIVSS

SEQ ID NO: 1492 - protein, 111 aa, Artificial Sequence
  VL
AAVLTQTPSPVSAAVGGTVTINCQASPSVYSDYLSWFQKKPGQPPKLLIYWASTLASGVPSRFSGSGSGTQFTLTISDLESDDVATYYCAGGYSGNSDNWAFGGGTDVVVK

SEQ ID NO: 1493 - protein, 112 aa, Artificial Sequence
  VH
QSLEESGGRLVTPGGSLTLTCTVSGIDLSSYGMGWVRQAPGKGLEWIGTISYGGSTFYANWVKGRFTISKTSTTVDLKVTSLTTEDAATYFCAREVPYWSLWGQGTLVTVSS

SEQ ID NO: 1494 - protein, 110 aa, Artificial Sequence
  VL
AYDMTQTPASVAAAVGGTVTIKCQASQSIGSDLSWYQQKRGQPPKLLIYDASTLASGVPSRFKGSGSGTEFTLTISDVQSADAATVYCQQDYSYRNVDNTFGGGTEVVVK

SEQ ID NO: 1495 - protein, 116 aa, Artificial Sequence
  VH
QSVEESGGRLVTPGTPLTLTCTVSGFSLSTYGMSWVRQAPGKGLEWIGIIDAGDSPYYASWVKGRFTISKTSTTVDLKITSLTTEDTATYFCARIAGSNHGPFSLWGPGTLVTVSS

SEQ ID NO: 1496 - protein, 109 aa, Artificial Sequence
  VL
DVVMTQTPASVSEPVGGTVTINCQASEFISNYLAWYQQKPGQPPKLLIYGASTLASGVPSRFSGSGSGTQFTLTISDLESDDAATYYCQCTAYGSGYVGFGGGTEVVVK

SEQ ID NO: 1497 - protein, 114 aa, Artificial Sequence
  VH
QSLEESGGRLVTPGTPLTLTCTVSGFSLHNYNIQWVRQAPGKGLEWIGWILTDGSPYCANWAKGRFTISKTSTTVDLKITSPTIEDTATYFCARMGDYNINGLWGPGTLVTVSS

SEQ ID NO: 1498 - protein, 112 aa, Artificial Sequence
  VL
AQVLTQTPSSVSAAVGGTVTINCQSSQRIYNNDFLSWYQQKPGQPPKLLIYAASTLASGVPSRFKGSGSGTQFTLTISDLESDDAATYYCQGGYSSSGWYLPFGGGTEVVVK

SEQ ID NO: 1499 - protein, 122 aa, Artificial Sequence
  VH
QSLEESGGRLVTPGTPLTLTCTASGIDLNNYAMSWVRQAPGKGLEWIGIISGAGYTYYTTWAKGRFTISKTSTTVDLKITSPTTEDTATYFCARIYDSYGYAYVPYYDMDLWGPGTLVTVSS

SEQ ID NO: 1500 - protein, 111 aa, Artificial Sequence
  VL
AAVLTQTPSPVSTAVGGTVTINCQSSQSVFMNNYLSWYQQKPGQPPKLLIYDASTLASRVPDRFSGSGSGTQFTLTISGVQSDDAAAYYCLGGYDDDSATTFGGGTEVVVE

SEQ ID NO: 1501 - protein, 117 aa, Artificial Sequence
  VH
QSVEESGGRLVTPGTFLTLTCTVSGFSLSSYAMNWVRQSPGKGLEWIGIIYSDDIAYYASWAKGRFTISKTSTTVTLKMTSLTVADTATYFCARGDGDRSIWSFDLWGPGTLVTVSS

SEQ ID NO: 1502 - protein, 112 aa, Artificial Sequence
  VL
AQVLTQTPSPVSAAVGGTVTISCQSSESVWNNNWLAWYQQKPGQPPNLLIYEASTLASGVSSRFKGSGSGTQFTLTVSEVQSDDAATYYCQGGYYDSSPIWTFGGGTEVVVK

SEQ ID NO: 1503 - protein, 120 aa, Artificial Sequence
  VH
QSVEESGGRLVTPGTPQTLTCTVSGFSLSSYAMSWVRQAPGKGLEWIGIISSSGSTYYASWAKGRFTISKTSTTVDLKITSPTTEDTATYFCARDAYPSYSPFGYYFTLWGQGTLVTVSS

SEQ ID NO: 1504 - protein, 110 aa, Artificial Sequence
  VL
AIKMTQTPASVSAAVGGTVSINCQASEDIYNYLAWYQQKPGQPPKLLIYDASDLASGVPSRFKGSGSGKQFTLTISGVQSDDAATYYCQHGYFTYSGENAFGGGTEVVVK

SEQ ID NO: 1505 - protein, 119 aa, Artificial Sequence
  VH
QSLEESGGDLVKPGASLTLTCTASGFSFSSSYYMCWVRQAPGKGLEWIACIYTGDGASYYASWAKGRFTISKPSSTTVTLQVTSLTAADTATYFCGRGEYDNDWGFGLWGPGTLVTVSS

SEQ ID NO: 1506 - protein, 108 aa, Artificial Sequence
  VL
AYDMTQTPASVEVPVGGTVTINCQASEDISSYLSWYQQKPGQPPELLIYYASNLASGVSSRFKGSRSGTEFTLTISDLESADAATYYCQCSNYGGSWTFGGGTEVVVK

SEQ ID NO: 1507 - protein, 118 aa, Artificial Sequence
  VH
QSVEESGGRLVTPGTPLTLTCTASGFSLSSSWMSWVRQAPGKGLEFIGFINTGGRAFYATWASGRFTISRTSTKVDLEITSPTSEDTATYFCVRGAAGYPEYDDGDLWGQGTLVTVSS

SEQ ID NO: 1508 - protein, 110 aa, Artificial Sequence
  VL
AQVLTQTLSPVSAAVGGTVTINCQSSPSVYHNNWLSWFQKKPGQPPKLLIYEASKLASGVPPRFSGSGSGTQFTLTISGVQSDDAATYYCAGSFSDNIYTFGGGTAMVVK

SEQ ID NO: 1509 - protein, 118 aa, Artificial Sequence
  VH
QSVEESGGRLVTPGTPLTLTCTVSGFSLSGYDMSWVRQAPGKGLEWIGYIYAGSTYYANWAKGRFTISKTSTTVDLKMTSPTTEDTATYFCTRVGAGYSGVWAYFNLWGPGTLVTVSS

SEQ ID NO: 1510 - protein, 112 aa, Artificial Sequence
  VL
AQVLTQTPSSVSAAVGGTVTINCQSSQSVDSDNYLAWYQQKPGQPPKLLIYDASKLASGVPSRFTGSGSGTQFTLTISGVQSDDAATYYCQGTYGNIGWYFAFGGGTEVVVK

SEQ ID NO: 1511 - protein, 117 aa, Artificial Sequence
  VH
QSVEESGGRLVTPGTPLTLTCTVSGIDLSSYTMGWVRQAPGKGLEYIGIIGTSGTTYYSSWAKGRFTISKTSTTVDLKITSPTTEDTATYFCARLGDDYGDFHFNLWGQGTLVTVSS

SEQ ID NO: 1512 - protein, 109 aa, Artificial Sequence
  VL
DLVMTQTPASVSEPVGGTVTIKCQASQNIGNYLAWYQQKPGQPPKLLIYAASNLASGVSSRFKGSGSGTEYTLTISDLESADAATYYCQCTYYDSTYFAFGGGTEVVVK

SEQ ID NO: 1513 - protein, 118 aa, Artificial Sequence
  VH
QSVEESGGRLVTPGTPLTLTCTVSGIDLSSSAMSWVRQAPGKGLEWIGIIGYNDFTYYANWAKGRFTISKTSTTVDLKMTSPTTEDTATYFCARGGSSSYSDYVFDPWGPGTLVTVSS

SEQ ID NO: 1514 - protein, 110 aa, Artificial Sequence
  VL
AFEMTQTPSSVSEPVGGTVTIKCQASQSIYSNLAWYQQKPGQRPKLLIYDASDLASGVPSRFSGSGYGTEFTLTISDLESADAATYYCQSYYGISSYGVAFGGGTEVVVK

SEQ ID NO: 1515 - protein, 119 aa, Artificial Sequence
  VH
QSVEESGGRLVTPGTPLTLTCTVSGFSLSTYYMSWVRQAPGKSLEWIGCIHGDDGSTWYASWVQGRFTISKASTTVDLQIASPTTEDTATYFCARGLPYWPNDGDFNLWGQGTLVTVSS

SEQ ID NO: 1516 - protein, 111 aa, Artificial Sequence
  VL
TQVLTQTPSPVSAAVGGTVSISCQSSQSVYNNNWLSWFQQKPGQPPKLLVYGASTLASGVPSRFKGSGSGTQFTLTISDLESDDAATYYCAGGYYTTSDNGFGGGTEVVVK

SEQ ID NO: 1517 - protein, 113 aa, Artificial Sequence
  VH
QSVEESGGRLVTPGTPLTLTCTVSGFSLSSYAMGWVRQAPGKGLEWIGWINTAGGTDYTSWAKGRFTISKTSTTVDLKVTSLTTEDTATYFCARYDYYYFDLWGQGTLVTVSS

SEQ ID NO: 1518 - protein, 110 aa, Artificial Sequence
  VL
AQVLTQTASSVSAAVGGTVTISCQSSQSVYDNNWLAWYQQKPGQPPKLLIYSASTLASGVPSRFKGSGSGTEFTLTISDLESDDAAAYYCHGVYSGSIHAFGGGTEVVVI

SEQ ID NO: 1519 - protein, 118 aa, Artificial Sequence; identical to SEQ ID NO: 183
  VH

SEQ ID NO: 1520 - protein, 110 aa, Artificial Sequence; identical to SEQ ID NO: 184
  VL

SEQ ID NO: 1521 - protein, 122 aa, Artificial Sequence
  VH
QEQLVESGGGLVQPEGSLTVTCTASGFSFSNSYWMCWVRQAPGKGLEWIACIYLGSAGTTHHATWAKGRFTISKTTSTTVTLQMTSLTAADTATYFCARAGHDYWGAYHTLWGPGTLVTVSS

SEQ ID NO: 1522 - protein, 110 aa, Artificial Sequence
  VL
DVVMTQTPASVSEPVGGSVTIKCQASQNIDNTLAWYQQKAGQPPKLLIYHASTLASGVPSRFRGSGSGTDFTLTISDLESADAATYYCQCPYYGSTYVYSFGGGTEVVVK

SEQ ID NO: 1523 - protein, 120 aa, Artificial Sequence
  VH
QSVEESGGRLVTPGTPLTLTCTVSGIDLSNHGMGWFRQGPGKGLEWIGIIYIDGGASYASWVNGRFTISKTSTTVDLKITSPTTEDTATYFCARGIPSDGDSSYYYFNLWGQGTLVTVAS

SEQ ID NO: 1524 - protein, 112 aa, Artificial Sequence
  VL
DVVMTQTPASVEAAVGGTVTIKCQASQSVYNKYLSWFQQKPGQPPKLLIYRASTLESGVSSRFKGSGSGTEFTLTISDLESADAATYYCQNNNGAGDNTDYTFGGGTEVVVK

SEQ ID NO: 1525 - protein, 122 aa, Artificial Sequence
  VH
QSVEESGGRLVTPGTPLTLTCTVSGFSLSRYAITWVRQAPGKGLEWIGIISSSGTTYYASWAKGRFTISKTSTTVDLKITSPTTEDTAIYFCARAIAGDAGYVYAIDWLDLWGQGTLVTVSS

SEQ ID NO: 1526 - protein, 111 aa, Artificial Sequence
  VL
DPVLTQTPSSASEPVGGTVTIKCQASEYISNYLSWYQQKPGQPPKLLIFGASTLESGVPSRFSGSGSGTEFTLTISGVQSADAATYYCQGGYFSSSTTYVAFGGGTEVVVR

SEQ ID NO: 1527 - protein, 117 aa, Artificial Sequence
  VH
QSLEESGGDLVKPGASLTLPCTASGFTLSGYWMCWVRQAPGKGLEWIGCIYNGDGSTYYASWAKGRFTISKTSSTTVTLQMTSLTAADTATYFCARDSNGWGAYGLWGPGTLVTVSS

SEQ ID NO: 1528 - protein, 110 aa, Artificial Sequence
  VL
AIEMTQTPSSVSAAVGGTVTIDCQASQSIGSYLSWYQQKPGQPPKLLIYDASDLASGVPSRFSGSGSGTEFTLTISGVQSDDAATYYCQGGYYSSATEIAFGGGTEVVVK

SEQ ID NO: 1529 - protein, 125 aa, Artificial Sequence
  VH
QSVEESGGRLVTPGTPLTLTCTVSGFSLSSYAMGWVRQAPGKGLEYIGVISTSANTYYATWAKGRFTISKTSTTVDLRITSPTTEDTATYFCARVVGLYDSYGDVDATYDAFDPWGPGTLVTVSS

SEQ ID NO: 1530 - protein, 112 aa, Artificial Sequence
  VL
AQVLTQTASPVSAAVGDTVTINCQSSQSVYNNNLLSWYQQKPGQPPKLLVYDASNLASGVPHRFSGSGSGTQFTLTISGVQSDDAATYYCLGGYDDDADIYAFGGGTEVVVK

SEQ ID NO: 1531 - protein, 118 aa, Artificial Sequence
  VH
QSVEESGGRLVTPGTPLTLTCTVSGFSLNSYDMSWVRQAPGKGLEWIGFISASGSIYFANWAKGRFTISKTSTTVDLKITSPTTEDTATYFCASDSYGWAYVYYFNLWGPGTLVTVSS

SEQ ID NO: 1532 - protein, 111 aa, Artificial Sequence
  VL
AVVLTQTPASVSAAVGGTVTINCRASEDIGSYLGWYQQKPGQPPKLLMHDASDLASGVPSRFSGSGSGTEFTLTISGVQSDDAATYYCQSAWYSSGTDKMAFGGGTEVVVK

SEQ ID NO: 1533 - protein, 113 aa, Artificial Sequence
  VH
QEQLVESGGGLVQPEGSLTLTCKASGFSFSSANCMHWVRQAPEKGLQWIGCVCIGDGTTYYASWVNGRFSISATSSTTVTIQMTSLTAADTATYFCARDLGLWGPGTLVTVSS

SEQ ID NO: 1534 - protein, 112 aa, Artificial Sequence
  VL
AIVMTQTPSSKSVPVGDTVTINCQASESVDKYTQCSWYQQKPGQPPKLLIYYASTLASGVPSRFKGSGSGTQFTLTISDVVSDDAATYYCSGYKGGSADMIAFGGGTELVVT

SEQ ID NO: 1535 - protein, 115 aa, Artificial Sequence
  VH
QSLEESGGRLVTPGTPLTLTCTVSGFSLSNYAMSWVRQAPGKGLEWIAIISGSGSTNYASWAKGRFTLSKASTTVALKITSPTTEDTATYFCGRGRDDDYAWDLWGQGTLVTVSS

SEQ ID NO: 1536 - protein, 109 aa, Artificial Sequence
  VL
DVVMTQTPASVSEPVGGTVTIKCQASQTISNYLAWYQQKPGQPPKLLIYAASTLASGVSSRFRGSGSGTEFSLTISDLESADAATYYCHCTYYDSSYHGFGGGTEVVVK

SEQ ID NO: 1537 - protein, 123 aa, Artificial Sequence
  VH
QEQLEESGGDLVKPEGSLTLTCTASGFSFSSAYYMCWVRQAPGKGLEWIACIDAGSSGSTYYASWAKGRFTISKTSSTTVTLQMTSLTAADTATYFCARDGGSTTGYGWLDLWGQGTLVTVSS

SEQ ID NO: 1538 - protein, 111 aa, Artificial Sequence
  VL
AVVMTQTASPVSAAVGGTVTINCQASQSIGTNYLSWYQQKPGQPPKLLIYEASNLETGVPSRFKGSGSGTEYSLTISDLESADAATYYCLYSYYSSSSAYTFGGGTEVVVK

SEQ ID NO: 1539 - protein, 116 aa, Artificial Sequence
  VH
QSVEESGGRLVTPGTPLTLTCTVSGFSLSTYNVAWVRQAPGKGLQYIGIMAFDGNTYYASWATGRFTISRTSTTVNLKITSPTTEDTATYFCCKGDPSSDTGTTLWGQGTLVTVSS

SEQ ID NO: 1540 - protein, 111 aa, Artificial Sequence
  VL
AAVLTQTPSSASEPVGGTVTIKCQSSPSVYSNNWLAWFQQKPGQRPKLLIYAAAKLASGVPSRFRGSGSGTQFTLTISDVQSDDAATYYCAGGFNSDSDTTFGGGTEVVVK

SEQ ID NO: 1541 - protein, 115 aa, Artificial Sequence
  VH
QSVEESGGRLVTPGTPLTLTCTASGFSLINYNMGWVRQAPGEGLEWIGTILTDGTVYYSNWAKGQFTISKTSTTVDLEMTSPTNEDTATYFCARDYPSYIAFDLWGPGTLVTVSS

SEQ ID NO: 1542 - protein, 112 aa, Artificial Sequence
  VL
AQVLTQTASSVSAAVGGTVTINCQASQSVYNDDNLAWLQQKPGQPPKLLIYGASSLASGVPSRFSGSGSGTEFTLTISGVQSEDAAIYYCQGGGFSSGWYWAFGGGTEVVVK

SEQ ID NO: 1543 - protein, 110 aa, Artificial Sequence
  VH
QSVEESGGRLVTPGTPLTLTCKVSGFSLSTYDMIWVRQAPAKGLEYIGIIGGSGFTYYANWAKGRFTISKTSTTVDLKITSPTTEDTATYFCARNNYDMWGPGTLVTVSS

SEQ ID NO: 1544 - protein, 111 aa, Artificial Sequence
  VL
DVVMTQTPASVSEPVGGTVTIKCQASQSISNELAWHQQKPGQRPNLLIYGASTLESGVPSRFKGSRSGTEYTLTISDLESDDAATYYCQCTYYGSSYVGGAFGGGTEVVVK

SEQ ID NO: 1545 - protein, 116 aa, Artificial Sequence
  VH
QSVEESGGRLVTPGTPLTLTCTVSGFSLGSYPMIWVRQAPGKGLEWIGYIDPGRGTTLYASWARGLFTISKTSTTVDLAMTSPTAADTATYFCARSYPGDGAGDLWGQGTLVTVSS

SEQ ID NO: 1546 - protein, 111 aa, Artificial Sequence
  VL
DVVMTQTPASVSEPVGGTVTIKCQASESISNYFSWYQQKPGQPPKLLIYGASTLESGVSSRFKGSGSGTDFTLTISDLESADAATYYCQCTYYGSGDVGGAFGGGTEVVVK

SEQ ID NO: 1547 - protein, 123 aa, Artificial Sequence
  VH
QEQLKETGGGLVQPGGSLTLSCKASGFDFSSGYMSWVRQAPGKGLEWIGYIDPVFGSTYYASWVNGRFAISSHNAQNTLYLQLNSLTAADTATYFCARDLRAFYSGWGGINLWGPGTLVTVSS

SEQ ID NO: 1548 - protein, 111 aa, Artificial Sequence
  VL
AAVLTQTPSPVSAAVGGTVTIKCQSSQIVVNNNFLSWYQQKPGQPPKLLIYDASNLASGVPDRFSGSGSGTQFTLTISGVQSDDAATYYCLGGYDDDAENAFGGGTEVVVQ

SEQ ID NO: 1549 - protein, 118 aa, Artificial Sequence
  VH
QSVEESGGRLVTPGTPLTLTCTVSGFSLNSYDMSWVRQAPGKGLEWIGFISASGSIYFASWAKGRFTISKTSTTVDLKITSPTTEDTATYFCASDSYGWAYVYYFNLWGPGTLVTVSS

SEQ ID NO: 1550 - protein, 111 aa, Artificial Sequence
  VL
AVVLTQTPASVSPAVGGTVTINCRASEDIGSYLGWYQQKPGQPPKLLMHDASDLASGVPSRFSGSGSGTEFTLTISGVQSDDAATYYCQSAWYSSNTDKMAFGGGTEVVVK

SEQ ID NO: 1551 - protein, 115 aa, Artificial Sequence
  VH
QSLEESGGRLVKPGESLTLTCTVSEFSLSSNAMGWVRQAPGKGLEFIGLIDSGGDAYYATWAKGRFTISKTSSTTVDLKATSLTTEDTATYFCGRGYWFPRLGLWGQGTLVTVSS

SEQ ID NO: 1552 - protein, 111 aa, Artificial Sequence
  VL
AAVLTQTPSPVSAAVGGTVSINCQSTKNVYLNNWLGWFQKKPGQPPKLLIYDASTLASGVPSRFKGSGSGTEFTLTISDLESDDAATYYCAGAYDDNSDHTFGGGTEVVVK

SEQ ID NO: 1553 - protein, 128 aa, Artificial Sequence
  VH
QEQLEESGGDLVKPEGSLTLTCTASGFSFNVDYYMCWVRQAPGKGLEWIACIYVGSEGSTYYASWAKGRFTISKTSSTTVTLQMTSLTAADTATYFCARHYAGYAGYNYATDYYFTLWGPGTLVTVSS

SEQ ID NO: 1554 - protein, 106 aa, Artificial Sequence
  VL
DIVMTQTPSSVSAGVGGTVTINCQASQSVTNFLSWYQQKPGQPPKLLIYGASTLASGVPSRFKGSGSGTEFTLTISGMKAEDVATYYCQSGYYSATFGAGTKVEIK

SEQ ID NO: 1555 - protein, 118 aa, Artificial Sequence
  VH
QSVEESGGRLVTPGTPLTLTCTVSGFSLSSYAVSWVRQAPWKGLEWIGIISSGGNTYYASWATGRFTISKTSTTVDLKITSPTTEDTATYFCARGIHSYDDYLGYKLWGPGTLVTVSS

SEQ ID NO: 1556 - protein, 108 aa, Artificial Sequence
  VL
AIEMTQSPPSLSASVGETVRIRCLASEFLFNAVSWYQQKPEKPPTLLISGASNLESGVPPRFSGSGSGTDYTLTIGGVQAEDVAAYYCLGGYKRADLTFGPGTKVEIK

SEQ ID NO: 1557 - protein, 117 aa, Artificial Sequence
  VH
QSVEESGGRLVTPGTPLTLTCTVSGFSLNDYAMSWVRQAPGKGLEWIGSIYTSGTPYYATWAKGRFTISKTSTTVDLKITSPTTEDTATYFCARQSGIDNYWLFTLWGQGTLVCVSS

SEQ ID NO: 1558 - protein, 110 aa, Artificial Sequence
  VL
AYDMTQTPASVEVGVGGTVTIKCQASESIASGLAWYQQKPGQRPKLLIYSASSLASGVSSRFKGSGSGTQFTLTISDLESADAANYYCQQGYTSTNLHNVFGGGTEVVVK

SEQ ID NO: 1559 - protein, 114 aa, Artificial Sequence
  VH
QSLEESGGRLVTPGTPLTLNCTASGFSLSAYWMGWVRQAPGKGLEWIGIIYATGSTYYTTWAKGRFTISRTSTTVDLKMTSPTTEDTATYFCGRGDGYESLNLWGPGTLVTVSS

SEQ ID NO: 1560 - protein, 110 aa, Artificial Sequence
  VL
AQVLTQTPSSVSAAVGGTVTINCQSSQSVYSNNLLSWYQQKPGQPPKRLIYGASTLDSGVSSRFKGSGSGTQFTLTISGMQSDDAATYYCLGYYSGGIYVFGGGTEVVVK

SEQ ID NO: 1561 - protein, 121 aa, Artificial Sequence
  VH
QSVEESGGRLVTPGTPLTLTCTASGFSLSSYYMSWVRQAPGKGLEWIGIIDTGSGDTWYATWAKGRFTISKTSTTVDLKMTSLTTEDTATYFCARVNPEFAHVWPYYFDLWGQGTLVTVSS

SEQ ID NO: 1562 - protein, 111 aa, Artificial Sequence
  VL
ALVMTQTPASVEVAVGGTVTIKCQASQSISSNFLSWYQQNPGQPPKLLIDRASTLESGVPSRFKGSGSGTEFTLTISDLESADAATYYCQQGDSLSNVENAFGGGTELVVK

SEQ ID NO: 1563 - protein, 116 aa, Artificial Sequence
  VH
QSVEESGGRLVTPGTPLTLTCTASGFSLSNYNMGWVRQAPGEGLEWIGHISTDGSAYYASWAKGRFTISKTSTTVDLKITSPTTEDTGTYFCARLYYRHGYALNLWGQGTLVTVSS

SEQ ID NO: 1564 - protein, 112 aa, Artificial Sequence
  VL
DIVMTQTPASVSEPVGGTVTIKCQASQSVGSYLAWYQQKSGQPPKLLIYSASTLASGVPSRFKGSGSGTEFTLTISDLVSADAATYYCHCTYGSNITANWGTFGGGTGVVVK

SEQ ID NO: 1565 - protein, 123 aa, Artificial Sequence
  VH
QEQLVESGGGLVQPEGSLTLTCKASGFDFNNNAMCWVRQAPGKGLEWIACIYDGSSGSTYYASWAKGRFTISKTSSSTVTLQMTSLTAADTATYFCARAYAAYTVYDYAFNLWGPGTLVTVSS

SEQ ID NO: 1566 - protein, 107 aa, Artificial Sequence
  VL
DVVMTQTPASVSEPVGGTVTIKCQASQSIGSDLAWYQQKPGQPPKLLIYYTTNLETGVSSRFKGSGSGTQFTLTISDLESADAATYYCQYADRSSYSFGGGTEVVVK

SEQ ID NO: 1567 - protein, 119 aa, Artificial Sequence
  VH
QSVEESGGRLVTPGTPLTLTCTVSGFSLSRYTMGWVRQAPGKGLEYIGIIYGDDNTYYASWAKGRLTISKTSSTTVDLKITSPTTEDTATYFCASCAPIYYNTFSFNLWGQGTLVTVSA

SEQ ID NO: 1568 - protein, 110 aa, Artificial Sequence
  VL
AYDMTQTPASVEVAVGGTVTIKCQASQTIGGSLSWYQQKPGQPPKLLIYAAATLASGVPSRFKGSGSGTQFTLTISGVESDDAATYYCQQHYTGDNVNNPFGGGTEVVVK

SEQ ID NO: 1569 - protein, 116 aa, Artificial Sequence
  VH
QSLEESGGRLVTPGTPLTLTCTVSGFSLSRYHMSWVRQAPGKGLEYIGYIHTDDTNWYASWAKGRFTISKTSTTVDLKITSPTTEDTATYFCARVSSVGGYYFDLWGQGTLVTVSS

SEQ ID NO: 1570 - protein, 110 aa, Artificial Sequence
  VL
DVVMTQTPASVSEPVGGTVTIKCQASEDIYNLLAWYQQKPGQPPKLLIYAASTLASGVPSRFKGSGSGTQFTLTISDLESADAATYYCQNNYLISSYGVGFGGGTEVVVK

SEQ ID NO: 1571 - protein, 118 aa, Artificial Sequence
  VH
QSVEESGGRLVTPGTPLTLTCTVSGFSLSGYDMSWVRQAPGKGLEWIGYIYGGNTYYANWAKGRFTISKTSTTVDLKMTSPTTEDTATYFCTRVGAGYSGVWAYFNLWGPGTLVTVSS

SEQ ID NO: 1572 - protein, 112 aa, Artificial Sequence
  VL
AQVLTQTPSSVSAAVGGTVTINCQSSQSVDSDNYLAWYQQKPGQPPKLLIYDTSKLASGVPSRFTGSGSGTQFTLTISGVQSDDAATYYCQGTYYNAGWYFAFGGGTEVVVK

SEQ ID NO: 1573 - protein, 119 aa, Artificial Sequence
  VH
QSLEESGGRLVTPGTPLTLTCTASGFSLTNYAMNWVRQAPGKGLEWIGFINYDGNTYYANWAKGRFTISRTSTTVDLKITSPTTEDTATYFCARGGDGYTHIPDTFDPWGPGTLVTVSS

SEQ ID NO: 1574 - protein, 110 aa, Artificial Sequence
  VL
AFEMTQTPSSVSVAVGGTVTIKCQASQSIYSYLSWYQQKPGQPPKLLIYYASTLASGVPSRFVGSGSGTQFTLTISGVESADAATYYCQQGYSYSNIDNVFGGGTEMVVK

SEQ ID NO: 1575 - protein, 116 aa, Artificial Sequence
  VH
QSVEESGGRLVTPGTPLTLTCTASGFDLSSYYMSWVRQAPGKGLEWIGIIYTDSSASYASWAKGRFTISRTSTTVDLKMTSPTTEDTATYFCARGLVVSTDNYNLWGPGTLVTVSS

SEQ ID NO: 1576 - protein, 110 aa, Artificial Sequence
  VL
AAVLTQTPSPVSVAVGGTVTINCQASQSIYNNNYLAWFQQKPGQPPKLLIYYTSTLASGVPSRFKGSGSGTQFTLTINGVQSDDAATYYCLGDVGGGMRVFGGGTEVVVK

SEQ ID NO: 1577 - protein, 118 aa, Artificial Sequence
  VH
QSLEESGGDLVKPGASLTLTCAASGFSLNNWVMCWVRQAPGKGLEWIACIDIVGSGSTHYATWAKGRFTMSKASSITVTLQMTSLTAADTATYFCARGVNGDGNLNLWGPGTLVTVSS

SEQ ID NO: 1578 - protein, 109 aa, Artificial Sequence
  VL
DVVMTQTPASVSEPVGGAVTIKCQASETISNYLAWYQQKPGQRPKLLIYGASNLESGVPSRFKGSGSGTEFTLTISDLESADAATYYCQCTYVGDSYTAFGGGTEVVVK

SEQ ID NO: 1579 - protein, 122 aa, Artificial Sequence
  VH
QSVEESGGRLVTPGTPLTLTCTVSGFSLSNYAMSWVRQAPGKGLEWIGIISPSGNTYYANWAKGRFTISKTSTTVDLKITSPTTEDTATYFCAREGALYDDYGDYVDAFDPWGPGTLVTVSS

SEQ ID NO: 1580 - protein, 112 aa, Artificial Sequence
  VL
AAVLTQTPSPVSAAVGGTVSISCQSSESVYNNNWLSWYQQKPGQPPKLLIYRASTLASGVPSRFKGSGSGTQFTLTISDVQSDDAATYYCAGGYSSSSDINAFGGGTEVVVK

SEQ ID NO: 1581 - protein, 121 aa, Artificial Sequence
  VH
QEQLEESGGDLVKPGASLTLTCTASGLSFSGSYWICWVRQAPGKGLEWIGCITAGISGSTYYASWAKGRFTISKTSSTTVTLQMTSLTAADTATYFCARERTGGWGDFNLWGPGTLVTVSS

SEQ ID NO: 1582 - protein, 111 aa, Artificial Sequence
  VL
DVVMTQTPASVEAAVGGTVTIKCQASQSITTYLSWYQQKPGQPPKLLIYLASTLESGVPSRFKGSRSGTEYTLTISDLESADAATYYCQCTDGGINHWFWAFGGGTEVVVK

SEQ ID NO: 1583 - protein, 120 aa, Artificial Sequence
  VH
QQRLVESGGGLVKPGASLTLTCTASGFSFSSGYDMCWVRQAPGKGLEWVGCIDTATDTIYYASWAPGRFTISKTSSTMVTLQMTSLTAADTATYFCARSVGGVDYAIDLWGPGTLVTVSS

SEQ ID NO: 1584 - protein, 110 aa, Artificial Sequence
  VL
AYDMTQTPVSVEVPVGGTVTIKCQASQNIGSRLVWYQQKPGQSPKFLIYYASNLASGVSSRFKGSGSGTQFTLTISDVQSDNAATYYCQQTYSYSDVDDTFGGGTEVVVK

SEQ ID NO: 1585 - protein, 115 aa, Artificial Sequence
  VH
QSLEESGGRLVTPGTPLTLTCTVSGFSLSTYAMIWVRQAPGEGPEWIGLIAGGGNTWYASWAKGRFTISKTSTTVDLKITSPTTEDTATYFCARADYLGYGNNFWGQGTLVTVSS

SEQ ID NO: 1586 - protein, 111 aa, Artificial Sequence
  VL
AAVLTQTPSPVSAAVGGTVTINCQASQSVYNNNYLAWYQQKPGQPPKLLIYWASNLASGVPSRFSGSGSGTQFSLTISGVQSDDAATYYCLGVYDDDADNGFGGGTEVVVK

SEQ ID NO: 1587 - protein, 115 aa, Artificial Sequence
  VH
QSVEESGGRLVTPGTPLTLTCTVSGFSLSSYAMIWVRQAPGKGLEYIGYISYDGSTYYASWVKGRFTISKTSTTVDLKMTSLTTEDTATYFCARARIDDGYGNLWGQGTLVTVSS

SEQ ID NO: 1588 - protein, 110 aa, Artificial Sequence
  VL
DVVMTQTPASVSEPVGGTVTIKCQASESISNYLAWYQQKPGQPPKLLIYAASYLASGVPSRFRGSGSGTEFTLTISDLESADAATYYCQCTYVASTYVGTFGGGTEVVVK

SEQ ID NO: 1589 - protein, 110 aa, Artificial Sequence
  VH
QSLEESGGRLVTPGTPLTLTCTASGFSLSTYYMTWVRQAPGKGLEWIGDIYVRGGARYANWAKGRFTISRTSTTVDLRITSPTTEDTATYFCAREGLSLWGQGTLVTVSS

SEQ ID NO: 1590 - protein, 113 aa, Artificial Sequence
  VL
AQVLTQTASPVSAAVGGTVTINCQSSQSVYKNNRLAWYQQKPGQPPKLLIYETSKLESGVSSRFKGSGSGTQFTLTISGVQSDDAATYYCLGGYDCGSADCNAFGGGTEVVVK

SEQ ID NO: 1591 - protein, 132 aa, Artificial Sequence
  VH
QQLEQSAGGAEGGLVKPGGSLELCCKASGFSLNNNYWICWVRQAPGKGLEWIGCIYVGVVSLTYSASWVNGRFTLSKDIDQSTGCLQLNSLTAADTAMYYCARSLYSGYAGYGDGYYGMDLWGPGTLVTVSS

SEQ ID NO: 1592 - protein, 109 aa, Artificial Sequence
  VL
GVVMTQTPASVSDPVGGTVTIKCQASQSIGSDLAWYQQKPGQPPKLLIYAASNLASGVSSRFSGIRSGTEFTLTISDLESADAATYYCQCTDYVDSHDTFGGGTEVVVK

SEQ ID NO: 1593 - protein, 117 aa, Artificial Sequence
  VH
QSVEESGGRLVTPGTPLTLTCTVSGIDLSSYAMSWVRQAPGKGLEYIGIISGSGNTYYASWAKGRFTISKTSTTVDLKISSPTTEDTATYFCCRGDPSYSIDGFDPWGPGTLVTVSS

SEQ ID NO: 1594 - protein, 112 aa, Artificial Sequence
  VL
AAVLTQTPSPVSAAVGGTVTINCQSSQSVYNNNDLAWYQQKPGQPPKLLIYRASNLASGVPSRFSGSGSGTQFTLTISGVQSGDAATYYCLGAWDDDADTWAFGGGTEVVVE

SEQ ID NO: 1595 - protein, 117 aa, Artificial Sequence
  VH
QSLEESGGRLVTPGTPLTLTCTASGFSLSNYYINWVRQAPGKGLEWIGIIDKSGSAYYASWARGRFTISKTSTTVGLKIPSPTTEDTATYFCARGYGGYADHGLGLWGQGTLVTVSS

SEQ ID NO: 1596 - protein, 110 aa, Artificial Sequence
  VL
DVVMTQTPASVSEPVGGTVTIKCQASQSIAGWLAWYQQKPGQPPKLLIYQASKLASGVPSRFSGSGSGTEYTLTISDLESDDAATYYCQCTYGSASGSNGFGGGTEVVVK

SEQ ID NO: 1597 - protein, 118 aa, Artificial Sequence
  VH
QSVEESGGRLVTPGTPLTLTCTVSGFSLSSFAMTWVRQAPGKGLEWIGIISSSGTTYYASWAKGRFTISKTSTTVDLRITSPTTEDTATYFCASHYDDYGDSDALDPWGPGTLVTVSS

SEQ ID NO: 1598 - protein, 109 aa, Artificial Sequence
  VL
AAVMTQTPSPVSAAVGGTVTINCQASEDIYSNLAWFQQKPGQPPKLLIYRASTLASGVPSRFSGSGSGTEFTLTISGLQSDDAATYYCLGVDRHISDRAFGGGTEVVVK

SEQ ID NO: 1599 - protein, 112 aa, Artificial Sequence
  VH
QEQLVESGGGLVQPEGSLTLTCKASGFDFSYNSMCWVRQAPGKGLEWITCIYNGDGSTWYASWAKGRFTISKTSSTTVTLQMTSLTAADTATYFCTRDFGLWGPGTLVTVSS

SEQ ID NO: 1600 - protein, 112 aa, Artificial Sequence
  VL
ALVMTQTPSSTSEPVGGTVTINCQASESVANHKQLSWYQQKPGQPPKVLIYYASTLASGVPSRFKGSGSGTQFTLTISDVVSDDAATYYCSGYKSISTDGNAFGGGTEVVVK

SEQ ID NO: 1601 - protein, 120 aa, Artificial Sequence
  VH
QSLEESGGRLVTPGTPLTLTCTVSGIDLSKYTMTWVRQAPGKGLEWIGLISFGGRGGTWYANWAKGRFTISKTSTTVDLRIASPTTEDTATYFCARARYSGTNYDYFNLWGQGTLVTVSS

SEQ ID NO: 1602 - protein, 110 aa, Artificial Sequence
  VL
AYDMTQTPASVEVAVGGTVTIKCQASQSISNWLAWYQQKPGQRPKLLIYGASNLESGVPSRFKGSGSGTDFTLTISDLESADAATYYCQQGYSSDGVTNAFGGGTEVVVE

SEQ ID NO: 1603 - protein, 118 aa, Artificial Sequence
  VH
QSLEESGGRLVTPGTPLTLICTVSGIDLSSGAMGWVRQAPGKGLEYIGYIYTGSGTTSYASWVNGRFTISMTSTTVDLKITSPTTEDTATYFCARDAASSYWGHFTLWGQGTLVTVSS

SEQ ID NO: 1604 - protein, 112 aa, Artificial Sequence
  VL
DIVMTQTPASVEAAVGGTVTIKCQASENIYSSLAWYQQKPGQPPKLLIYRTSTLASGVPSRFKGSGSGTQFTLTISDLESDDAATYYCQSYYHNSGGGYDYGFGGGTEVVAK

SEQ ID NO: 1605 - protein, 121 aa, Artificial Sequence
  VH
QQQLVESGGGLVKPGASLTLTCKASGFFFSGSYYMCWVRQAPGKGLEWIACIYTGSDDDTNYASWAKGRFTISKTSSTTVTLQMTSLTAADTATYFCARRNYDTDWGGDLWGPGTLVTVSS

SEQ ID NO: 1606 - protein, 110 aa, Artificial Sequence
  VL
AVVLTQTPASVEAAVGGTVTIKCQASQSIGSSLAWYQQKPGQRPKLLIYYASNLASGVSSRFKGSGSGTQFTLTISDLESADAATYYCQCTYTSSDYLDAFGGGTEVVVK

SEQ ID NO: 1607 - protein, 125 aa, Artificial Sequence
  VH
QEQLEESGGGLVQPEGSLTLTCTASGFSFSYYWMCWVRQAPGKGLEWSACIGTGSGSTYYATWAKGRFTISKTSSTTVTLQMTSLTAADTATYFCARDWGIYSSDAYYMDYFNLWGPGTLVTVSS

SEQ ID NO: 1608 - protein, 110 aa, Artificial Sequence
  VL
AFELTQTPASVEAAVGGTVTIKCQASQSIGSYLAWYQQKPGQPPKPLIYEASKLASGVSSRFKGSGSGTQFTLTISGVESADAATYYCQQGGISTNVQNAFGGGTEVVVK

SEQ ID NO: 1609 - protein, 114 aa, Artificial Sequence
  VH
QEQLKESGGGLVTPGGTLTLTCTASGFTFSSHAMGWVRQAPGKGLEWIGKIYDDGTTFYANWAKGRFTISRTSTTVDLKMTSLTTEDTATYFCLRGYNSGFNFWGQGTLVTVSS

SEQ ID NO: 1610 - protein, 110 aa, Artificial Sequence
  VL
AQVLTQTPASVSAAVGGTVTISCQSSESVYNNNFLAWYQQKPGQPPKLLIYLASTLASGVPSRFSGSGSGTEFTLTISDLDSDDAATYYCAGGYDDNVYGFGGGTEVVVK

SEQ ID NO: 1611 - protein, 123 aa, Artificial Sequence
  VH
QEQLVESGGGLVQPEGSLTLTCTASGFSFSNNAMCWVRQAPGKGLEWIACIYDGSSGSTYYATWAKGRFTISKTSSTTVTLQMTSLTAADTATYFCARAYGGYTVYDYAFNLWGPGTLVTVSS

SEQ ID NO: 1612 - protein, 107 aa, Artificial Sequence
  VL
DVVMTQTPASVSEPVGGTVTIKCQASQSIGSDLAWYQQKPGQPPKLLIYYTTNLETGVSSRFKGSRSGTEYALTISDLESADAATYYCQYGVRSTYSFGGGTEVVVK

SEQ ID NO: 1613 - protein, 119 aa, Artificial Sequence
  VH
QEQLKESGGDLVTPGTPLTLTCTVSGFSLSSYAMAWVRQAPGKGLEYIGFIDTDGSAYYASWAKGRFTISRTSTTVDLKITSPTTEDTATYFCAGDSYGYAGFVYFNLWGPGTLVTVSS

SEQ ID NO: 1614 - protein, 110 aa, Artificial Sequence
  VL
DVVMTQTPASVSEPVGGTVTIKCQASQNIYSSLAWYQQKPGQPPKLLIYDASDLASGVPSRFKGSGSGTQFTLTISDLESDDAATYYCQCSYYGVDYVGGFGGGTEVVVK

SEQ ID NO: 1615 - protein, 116 aa, Artificial Sequence
  VH
QSLEESGGRLVTPGGSLTLTCTVSGIDLSRWTMSWVRQAPGKGLEWIGLIYASDDTVYASWAKGRFTISKTSTTVDLKITSPTTEDTATYFCVRVYGSTSGYYDLWGQGTLVTVSS

SEQ ID NO: 1616 - protein, 110 aa, Artificial Sequence
  VL
DVVMTQTPASVSEPVGGTVTIKCQASQSISNWLAWYQQKPGQPPKLLIYYASTLASGVPSRFKGSGSGTQFTLTISDLESADAATYYCQNFGDGNSIGHAFGGGTEVVVK

SEQ ID NO: 1617 - protein, 117 aa, Artificial Sequence
  VH
QSLEESGGRLVTPGTPLTLTCTASGFSLSNYYMNWVRQAPGKGLEWIGIIDKSGSAYYASWARGRFTISKTSTTVGLKIPSPTTEDTATYFCARGYGGYADHGLGLWGQGTLVTVSS

SEQ ID NO: 1618 - protein, 110 aa, Artificial Sequence
  VL
DVVMTQTPASVSEPVGGTVTIKCQASQSIAGWLAWYQQKPGQPPKLLIYQASKLASGVPSRFSGSGSGTEYTLTISDLESDDAATYYCQCTYGSGSGSNGFGGGTEVVVK

SEQ ID NO: 1619 - protein, 114 aa, Artificial Sequence
  VH
QSVEESGGRLVKPDETLTLICTVSGIDLSINVVGWVRQAPGEGLEWIGDISSHGDTIYATWAKGRFTISKTSTTVDLKMTSLTASDTATYFCARYVGDGYYDLWGPGTLVTVSS

SEQ ID NO: 1620 - protein, 110 aa, Artificial Sequence
  VL
AYDMTQTPASVSAAVGGTVTINCQASQSISNLLAWYQQKPGQRPKLLIYDTSKLASGVPSRFKGSGSGTQFTLTISDLESADAATYYCQQSYSSSNIANLFGGGTEVVVK

SEQ ID NO: 1621 - protein, 126 aa, Artificial Sequence
  VH
QSVEESGGRLVTPGTPLTLTCTVSGFSLRHYAMSWVRQAPGKGLEWIGVITTTANTYYASWAKGRFTVSKASSTTVDLKIMSPTIEDTATYFCARAMGLYDSYVDVDDTHDAFDPWGPGTLVTVSS

SEQ ID NO: 1622 - protein, 113 aa, Artificial Sequence
  VL
AQVLTQTASPVSAAVGGTVTINCQSSQSVYNSHVLSWYQQKPGQPPKLLIYDASNLASGVPSRFSASGSGTQFTLTISGVQSDDAATYYCLGGYDDDADNIFAFGGGTEVVVA

SEQ ID NO: 1623 - protein, 120 aa, Artificial Sequence
  VH
QERLVESGGGLVKPGASLTLTCTASGFSFSSGYDMCWVRQAPGKGLEWVGCIDTGTGTIYYASWAPGRFTISETSSTMVTLQMTSLTAADTATYFCARSVGGYDYAIDLWGPGTLVTVSS

SEQ ID NO: 1624 - protein, 110 aa, Artificial Sequence
  VL
AYDMTQTPASVEVPVGGTVTIKCQASQNIGSRLVWYQQKPGQSPKFLIYYASNLASGVSSRFKGSGSGTQFTLTISDVQSDNAATYYCQQTYSYSDVDDTFGGGTEVVVK

SEQ ID NO: 1625 - protein, 115 aa, Artificial Sequence
  VH
QSVEESGGRLVTPGTPLTLTCTVSGIDLSSYAMGWVRQAPGKGLEYIGIISYDGSTYYASWAKGRFTISKTSTTVDLKITSPTTEDTATYFCARVDYGDYNFALWGQGTLVTVSS

SEQ ID NO: 1626 - protein, 109 aa, Artificial Sequence
  VL
DVVMTQTPASVSEVVGGTVTIKCQASESISNYLAWYQQKPGQPPKLLIYAASNLASGVPSRFSGSGSGTQFTLTISDLESADAATYYCQCTYYVSSYFAFSGGTEVVVK

SEQ ID NO: 1627 - protein, 115 aa, Artificial Sequence
  VH
QEQLKESGGGVVTPGGTLTLTCTASAFSLNHYNIQWVRQAPGKGLEWIGWILTDGTEYYANWAKGRFTISKTSTTVDLKIASPTTEDTATYFCAREGDWGVDSLWGPGTLVTVSS

SEQ ID NO: 1628 - protein, 112 aa, Artificial Sequence
  VL
ALVMTQTPSPVSAAVGGTVTISCQSSQSVDNNDFLSWYQQKPGQPPKLLIYLASKLASGVPSRFSGSGSGTQFTLTISGVQSDDAATYYCKGLYFDSGWYAAFGGGTEVVVE

SEQ ID NO: 1629 - protein, 117 aa, Artificial Sequence
  VH
QSVEESGGRLVTPGTPLTLTCTVSGFSLSSYDMSWVRQAPGKGLEWIGIIYVSGTTDYASWAKGRFTISKTSTTVDLKMTSLTTEDTATYFCARDIYVDEIGCFDLWGQGTLVTVSS

SEQ ID NO: 1630 - protein, 108 aa, Artificial Sequence
  VL
DILMTQTPASVEVAVGGTVTIKCQASQNIRTYLAWYQQKPGQPPKLLIYRASTLESGVPSRFKGSGSGIEFSLTISDLESADAATYYCQNYDGGSSTGFGGGTEVVVK

SEQ ID NO: 1631 - protein, 112 aa, Artificial Sequence
  VH
QSVEESGGRLVTPGGSLTLTCTVSGIDLSSADMSWVRQAPGEGLEYIGWINNVGSAYYASWAKGRFSISKTSSTTVDLKVTSLTTEDTATYFCVRGYWLDLWGQGTLVTVSS

SEQ ID NO: 1632 - protein, 111 aa, Artificial Sequence
  VL
AAVLTQTPSPVSAAVGGTVSISCQSSVNVYNNNYLAWFQQKPGQPPKLLIYAASTLPSGVSSRFSGNGSGTEFTLTISGVQSDDAATYYCVGYYSSTDDNGFGGGTEVVVK

SEQ ID NO: 1633 - protein, 117 aa, Artificial Sequence
  VH
QSVEESGGRLVTPGTPLTLTCTASGFTLSSYYMGWVRQAPGKGLEWIGIIYPSGSAYYATWTKGRFTISRTSTTVDLKVTGPTTEDTATYFCARSTTSSLYYGYNLWGQGTLVTVSS

SEQ ID NO: 1634 - protein, 111 aa, Artificial Sequence
  VL
DIVMTQTPASVEAAVGGTVTIKCQASASITNWLAWYQQKPGQPPKLLIYKASTLESGVPSRFKGSGSGTEFTLTISDLESADAASYYCQSNYGGGSDTSHTFGGGTGVVVK

SEQ ID NO: 1635 - protein, 116 aa, Artificial Sequence
  VH
QSVEESGGRLVTPGTPLTLTCTVAGIDLNICGMSWVRQAPGKGLEWIGIIYPSDYTYYATWAKGRFTISKTSTTVDLKITSPTTEDTATYFCARGLGHAWSHFDLWGQGTLVTVSS

SEQ ID NO: 1636 - protein, 111 aa, Artificial Sequence
  VL
AFELTQTPASVSEPVGGTVTIKCQASQSIGSDLAWYQQKPGQPPKLLIYSVSNLPSGVSSRFKGSRSGTEYTLTISDLESADAATYYCQSYYGTITTGYIAFGGGTEVVVK

SEQ ID NO: 1637 - protein, 118 aa, Artificial Sequence; identical to SEQ ID NO: 1531
  VH

SEQ ID NO: 1638 - protein, 111 aa, Artificial Sequence
  VL
AVVLTQTPASVSAAVGGTVTINCRASEDVGSYLGWYQQRAGQPPKLLMHDASDLASGVPSRFSGSGSGTEFTLTISGVQSDDAATYYCQSAWLGTNTDKMAFGGGTEVVVK

SEQ ID NO: 1639 - protein, 117 aa, Artificial Sequence
  VH
QSVEESGGRLVTPGGSLTLTCTASGFDLSSYATSWVRQAPGKGLEWIGIIYGSGSTTYASWVKGQFTISKSSSTTVDLKMTSLTTEDTATYFCARGLVASTDNYNLWGPGTLVTVSS

SEQ ID NO: 1640 - protein, 110 aa, Artificial Sequence
  VL
AAVLTQTPSPVSVAVGGTVTINCQASQSVYNNNYLAWFQQKPGQPPKLLIYLASILASGVPSRFKGSGSGTQFTLTINGVQSDDAATYYCLGDVGGGERVFGGGTEVVVK

SEQ ID NO: 1641 - protein, 117 aa, Artificial Sequence
  VH
QSVEESGGRLVTPGTPLTLTCTVSGFSLSNYHMCWVRRAPGKGLEWIGSITTADETTHYANWAKGRFTISETSTTVDLRITSPTTEDTAIYFCGRTIRYDDYAVDLWGPGTLVTVSS

SEQ ID NO: 1642 - protein, 109 aa, Artificial Sequence
  VL
DLVMTQTPASMSEPVGGTVTIKCQASESVGGYLAWYQQKAGQRPKLLIYAAGNLASGVPSRFKGSGSGTEYTLTISDLESADAATYYCQCTYFDSSYVGFGGGTEVVVR

SEQ ID NO: 1643 - protein, 116 aa, Artificial Sequence
  VH
QSLEESGGRLVTPGTPLTLTCTASGFSLIKSHINWVRQAPGKGLEWVGGIAYDDNTYYANWAKGRFTISKTSTTVDLRITSPTTADTATYFCAREDSSGWGSFNLWGQGTLVTVSS

SEQ ID NO: 1644 - protein, 113 aa, Artificial Sequence
  VL
AQVLTQTPSSVSAAVGGTVTISCQSSQSVYATNQLSWFQQKSGQPPKRLIYSASTLASGVSSRFKGSGSGTQFTLTISGVQSDDAATYYCQGAYDCSGGDCRAFGGGTEVVVK

SEQ ID NO: 1645 - protein, 116 aa, Artificial Sequence
  VH
QSLEESGGRLVAPGTPLTLTCTVSGIDLSRYAMGWVRQAPGKGLEYIGIIDDNDITYFATWAKGRFTISKTSTTLGLKITSPTTEDTATYFCARTADYADYSFGLWGPGTLVTVSS

SEQ ID NO: 1646 - protein, 109 aa, Artificial Sequence
  VL
DVVMTQTPTSVSEPVGGTVTIKCQASENIGNYLAWYQQRPGQRPKLLIYAASNLASGVPSRFKGSGSGTEYALTISDLESDDAATYYCQCTYDDSEYFVFGGGTEVVVK

SEQ ID NO: 1647 - protein, 112 aa, Artificial Sequence
  VH
QQQLEESGGGLVKPGGTLTLTCTASGIDFSSYWMWWVRQPPGKGLEWVACIYNGDGSTYYASWAKGRFTISKTSSTTVTLQMTSLTAADTATYFCARDFHLWGPGTLVTVSS

SEQ ID NO: 1648 - protein, 113 aa, Artificial Sequence
  VL
AQVLTQTASPVSAAVGSTVTINCQASQNIYKNNYLSWYQQKPGQPPKGLIYSASTLDSGVPLRFSGSGSGTKFTLTISDVQSDDAATYYCLGSVACSGPDCIVFGGGTEVVVK

SEQ ID NO: 1649 - protein, 121 aa, Artificial Sequence
  VH
QSLEESGGGLVQPGGSLKLSCKASGIDFSSYGVSWVRQAPGKGLEWIAYTYPDYGSTDYASWVNGRFTISLDNAQNTVFLQMTSLTAADTATYFCASSSNGWGGGFYFDLWGPGTLVTVSS

SEQ ID NO: 1650 - protein, 111 aa, Artificial Sequence
  VL
ALVMTQTPSPVSAAVGGTVTINCQASEDIYSNLAWFQQKPGQPPKLLIYGASTLASGVPSRFSGSGSGTEFTLTINDLKSDDAATYYCLGVYTYITTDPNAFGGGTEVVVK

SEQ ID NO: 1651 - protein, 129 aa, Artificial Sequence
  VH
QSLEESGGDLVKPGGTLTLTCKASGIDFNNYYVCWVRQAPGKGLEWVGCIYTGSGSTYYASWAKGRFTITRSSSTTVTLQMTSLTAADTATYFCARPEFYDTYGYAGYGYATPNYFNFWGPGTLVTVSS

SEQ ID NO: 1652 - protein, 112 aa, Artificial Sequence
  VL
AAVLTQTPSPVSAAVGGTVTIKCQASQSVYNNNLLSWYQQKPGQPPKLLMYDASNLASGVPDRFSGSGSGTQFTLTISDLESDDAATYYCLGGYDDDADYNAFGGGTEVVVA

SEQ ID NO: 1653 - protein, 115 aa, Artificial Sequence
  VH
QSVEESGGRLVTPGTPLTLTCTVSGFSLSSSTMGWFRQAPGKGLEWIGVIYTDGDTYYARWAKGRFTISKTSTTINLSITSPTSEDTATYFCARRANGYDDFDPWGPGTLVTVSS

SEQ ID NO: 1654 - protein, 110 aa, Artificial Sequence
  VL
AYDMTQTPASVEVAVGGTVTIKCQASESISSYLNWYQQKPGQPPKLLIYYESYLASGVPSRFKGSGSGTEYTLTISGVESADAATYYCQQGFSYINVDNTFGGGTEVVVK

SEQ ID NO: 1655 - protein, 115 aa, Artificial Sequence
  VH
QSLEESGGRLVTPGTPLTLTCTASGFSLNMFYMIWVRQAPGKGLEWIGMIDSMGSAWYASWAKGRFTISKTSTAVALKITSPTTEDTATYFCARAINGDGAGDLWGQGTLVTVSS

SEQ ID NO: 1656 - protein, 110 aa, Artificial Sequence
  VL
DVVMTQTPASVSAAVGGTVTINCRASEKIDSFLAWYQQKPGQPPKLLIYGASELAPGVPSRFSGSGSGTDYTLTISALESADAATYYCQSTADGSDYVGTFGGGTEVVVK

SEQ ID NO: 1657 - protein, 114 aa, Artificial Sequence
  VH
QSLEESGGRLVTPGGSLTLTCTLSGIDLSSNAISWVRQAPGKGLEWIGIIFPGDNIYYATWAKGRFTISKTSTTVDLKMTSLRTADTATYFCARYHADDSVDLWGPGTLVTVSS

SEQ ID NO: 1658 - protein, 110 aa, Artificial Sequence
  VL
AYDMTQTPASVSEPVGGTVTIKCQASQSINGWLSWYQQKPGQRPRLLIYRASDLAPGVSSRFKGSGSGTQFTLTISDVESADAATYYCHLGDIYSNIDYVFGGGTEVVVK

SEQ ID NO: 1659 - protein, 118 aa, Artificial Sequence
  VH
QSVEESGGRLVTPGTPLTLTCTVSGFSLNSYDMSWVRQAPGKGLEWIGFISAIDNTYYASWAKGRFTISKTSTTVDLKITSPTTEDTATYFCASDSYGWAYVYYFNLWGPGTLVTVSS

SEQ ID NO: 1660 - protein, 111 aa, Artificial Sequence
  VL
AVVLTQTPASVSATVGGTVTINCRASEDIGSYLGWYQQKPGQPPKLLIHDASDLASGVPSRFSGSGSGTEFTLTISGVQSDDAATYYCQSAWYSSDSDKMAFGGGTEVVVK

SEQ ID NO: 1661 - protein, 116 aa, Artificial Sequence
  VH
QSVEESGGRLVTPGTPLTLTCTVSGFSLSTYGMSWVRQAPGKGLEWIGIIDGGDSPYYASWAEGRFTISKTSTTVDLKITSPTTEDTATYFCARIAGSNHGPFDLWGPGTLVTVSS

SEQ ID NO: 1662 - protein, 109 aa, Artificial Sequence
  VL
DVVMTQTPASVSEPVGGTVTINCQASEFISNYLAWYQQKPGQPPKLLIYGASTLASGVPSRFKGSGSGTDFTLTISDLESADAATYYCQCTAYGSSYVGFGGGTEVVVK

SEQ ID NO: 1663 - protein, 112 aa, Artificial Sequence
  VH
QSVEESGGRLVTPGTPLTLTCTVSGFSLSSYAMSWVRQAPGKGLEWIGDINSYATTYYASWAKGRFTISKTSTTVDLKLTSPTTEDTATYFCAREAGYADLWGQGTLVTVSS

SEQ ID NO: 1664 - protein, 110 aa, Artificial Sequence
  VL
AYDMTQTPASVEVAVGGTVTIKCQASQSISRYLSWYQQEPGQRPKLLIYEASTLASGVSSRFKGSGSGTQFTLTISGVESADAATYYCQQDYDSTDVGNTFGGGTEVVVK

SEQ ID NO: 1665 - protein, 122 aa, Artificial Sequence
  VH
QSLEESRGGLVQPEGSLTLTCKASGFSFSSGYYMCWVRQAPGKGLEWIGCIYSGSDSACYASWAKGRFTISKTSSTTVTLQMTSLTVADTATYFCVRDLGDYNALSYTINLWGPGTLVTVSS

SEQ ID NO: 1666 - protein, 109 aa, Artificial Sequence
  VL
DVVMTQTPSSVSAAVGGTVTIKCQASQSISTNLAWYQEKAGQPPKLLIYRASTVASGVPSRFKGSGSGTQFTLTISDLESADATTYFCQCIDYDDYGGTFGGGTEVVVK

SEQ ID NO: 1667 - protein, 112 aa, Artificial Sequence
  VH
QSVEESGGRLVTPGTPLTLTCTASGFSLSDYYMSWVRQAPGKGLEWIGFMNSGGNAYYASWASGRFTISKTSTTVDLKITSPTTEDTATYFCVRDLSRFSLWGRGTLVIVSS

SEQ ID NO: 1668 - protein, 111 aa, Artificial Sequence
  VL
AAVLTQTPSPVSAAVGGTVTINCQASPSVYSDYLSWFQQKPGQAPKLLIYWASTLTSGVPSRFSGSGSGTQFTLTISDVQSDDAATYYCAGGYSGNSDVWAFGGGTEVVVK

SEQ ID NO: 1669 - protein, 127 aa, Artificial Sequence
  VH
QSLEESGGDLVKPGASLTLTCTASGFSFDIDYYMCWVRQAPGKGLEWIACIYAGSSGSTYYASWAKGRFTISKTSSTTVTLQMPSLTAADTATYFCARHYAGYAGDAYATDYYFNLWGRGTLVTVSS

SEQ ID NO: 1670 - protein, 106 aa, Artificial Sequence
  VL
DIVMTQTPSSVSATVGDTVTINCQASQSVSNFLAWYQQKPGQPPKPLIYGASNLESGVPSRFRGSGSGTEFTLTISGMKAEDAATYYCQSGYYSATFGAGTKVEIK

SEQ ID NO: 1671 - protein, 119 aa, Artificial Sequence
  VH
QSLEESGGGLVKPGASLTLTCKASGFDLSSYYYMCWVRQAPGKGLEWIGCFYTDDSANTWYATWAKGRFTISKTSSTTVTLQMTSLTAADTATYFCARDASGWYWFNLWGPGTLVTVSS

SEQ ID NO: 1672 - protein, 110 aa, Artificial Sequence
  VL
AQVLTQTPSPVSAAVGGTVTISCQSSQSLHDDNALAWYQQKPGQPPKLLIYLASYLASGVPSRFKGSGSGTQFTLTISEVQSDDAATYYCQGAYSGDNNSFGGGTEVVVK

SEQ ID NO: 1673 - protein, 8 aa, Artificial Sequence
  HCDR1
GFSLSSYA

SEQ ID NO: 1674 - protein, 7 aa, Artificial Sequence
  HCDR2
ISSSGVT

SEQ ID NO: 1675 - protein, 16 aa, Artificial Sequence
  HCDR3
ARDPGYSTGWDYFFRL

SEQ ID NO: 1676 - protein, 6 aa, Artificial Sequence
  LCDR1
EDIESY

SEQ ID NO: 1677 - protein, 3 aa, Artificial Sequence
  LCDR2
DAS

SEQ ID NO: 1678 - protein, 14 aa, Artificial Sequence
  LCDR3
QHGAYTSSSDFFYA

SEQ ID NO: 1679 - protein, 8 aa, Artificial Sequence
  HCDR1
GFSLSRYY

SEQ ID NO: 1680 - protein, 7 aa, Artificial Sequence
  HCDR2
INTAGSA

SEQ ID NO: 1681 - protein, 9 aa, Artificial Sequence
  HCDR3
ARDLSRFSL

SEQ ID NO: 1682 - protein, 7 aa, Artificial Sequence
  LCDR1
PSVYSDY

SEQ ID NO: 1683 - protein, 3 aa, Artificial Sequence
  LCDR2
WAS

SEQ ID NO: 1684 - protein, 12 aa, Artificial Sequence
  LCDR3
AGGYSGNSDNWA

SEQ ID NO: 1685 - protein, 8 aa, Artificial Sequence
  HCDR1
GIDLSSYG

SEQ ID NO: 1686 - protein, 7 aa, Artificial Sequence
  HCDR2
ISYGGST

SEQ ID NO: 1687 - protein, 9 aa, Artificial Sequence
  HCDR3
AREVPYWSL

SEQ ID NO: 1688 - protein, 6 aa, Artificial Sequence
  LCDR1
QSIGSD

SEQ ID NO: 1689 - protein, 3 aa, Artificial Sequence
  LCDR2
DAS

SEQ ID NO: 1690 - protein, 12 aa, Artificial Sequence
  LCDR3
QQDYSYRNVDNT

SEQ ID NO: 1691 - protein, 8 aa, Artificial Sequence
  HCDR1
GFSLSTYG

SEQ ID NO: 1692 - protein, 7 aa, Artificial Sequence
  HCDR2
IDAGDSP

SEQ ID NO: 1693 - protein, 13 aa, Artificial Sequence
  HCDR3
ARIAGSNHGPFSL

SEQ ID NO: 1694 - protein, 6 aa, Artificial Sequence
  LCDR1
EFISNY

SEQ ID NO: 1695 - protein, 3 aa, Artificial Sequence
  LCDR2
GAS

SEQ ID NO: 1696 - protein, 11 aa, Artificial Sequence
  LCDR3
QCTAYGSGYVG

SEQ ID NO: 1697 - protein, 8 aa, Artificial Sequence
  HCDR1
GFSLHNYN

SEQ ID NO: 1698 - protein, 7 aa, Artificial Sequence
  HCDR2
ILTDGSP

SEQ ID NO: 1699 - protein, 11 aa, Artificial Sequence
  HCDR3
ARMGDYNINGL

SEQ ID NO: 1700 - protein, 8 aa, Artificial Sequence
  LCDR1
QRIYNNDF

SEQ ID NO: 1701 - protein, 3 aa, Artificial Sequence
  LCDR2
AAS

SEQ ID NO: 1702 - protein, 12 aa, Artificial Sequence
  LCDR3
QGGYSSSGWYLP

SEQ ID NO: 1703 - protein, 8 aa, Artificial Sequence
  HCDR1
GIDLNNYA

SEQ ID NO: 1704 - protein, 7 aa, Artificial Sequence
  HCDR2
ISGAGYT

SEQ ID NO: 1705 - protein, 19 aa, Artificial Sequence
  HCDR3
ARIYDSYGYAYVPYYDMDL

SEQ ID NO: 1706 - protein, 8 aa, Artificial Sequence
  LCDR1
QSVFMNNY

SEQ ID NO: 1707 - protein, 3 aa, Artificial Sequence
  LCDR2
DAS

SEQ ID NO: 1708 - protein, 11 aa, Artificial Sequence
  LCDR3
LGGYDDDSATT

SEQ ID NO: 1709 - protein, 8 aa, Artificial Sequence
  HCDR1
GFSLSSYA

SEQ ID NO: 1710 - protein, 7 aa, Artificial Sequence
  HCDR2
IYSDDIA

SEQ ID NO: 1711 - protein, 14 aa, Artificial Sequence
  HCDR3
ARGDGDRSIWSFDL

SEQ ID NO: 1712 - protein, 8 aa, Artificial Sequence
  LCDR1
ESVWNNNW

SEQ ID NO: 1713 - protein, 3 aa, Artificial Sequence
  LCDR2
EAS

SEQ ID NO: 1714 - protein, 12 aa, Artificial Sequence
  LCDR3
QGGYYDSSPIWT

SEQ ID NO: 1715 - protein, 8 aa, Artificial Sequence
  HCDR1
GFSLSSYA

SEQ ID NO: 1716 - protein, 7 aa, Artificial Sequence
  HCDR2
ISSSGST

SEQ ID NO: 1717 - protein, 17 aa, Artificial Sequence
  HCDR3
ARDAYPSYSPFGYYFTL

SEQ ID NO: 1718 - protein, 6 aa, Artificial Sequence
  LCDR1
EDIYNY

SEQ ID NO: 1719 - protein, 3 aa, Artificial Sequence
  LCDR2
DAS

SEQ ID NO: 1720 - protein, 12 aa, Artificial Sequence
  LCDR3
QHGYFTYSGENA

SEQ ID NO: 1721 - protein, 9 aa, Artificial Sequence
  HCDR1
GFSFSSSYY

SEQ ID NO: 1722 - protein, 8 aa, Artificial Sequence
  HCDR2
IYTGDGAS

SEQ ID NO: 1723 - protein, 13 aa, Artificial Sequence
  HCDR3
GRGEYDNDWGFGL

SEQ ID NO: 1724 - protein, 6 aa, Artificial Sequence
  LCDR1
EDISSY

SEQ ID NO: 1725 - protein, 3 aa, Artificial Sequence
  LCDR2
YAS

SEQ ID NO: 1726 - protein, 10 aa, Artificial Sequence
  LCDR3
QCSNYGGSWT

SEQ ID NO: 1727 - protein, 8 aa, Artificial Sequence
  HCDR1
GFSLSSSW

SEQ ID NO: 1728 - protein, 7 aa, Artificial Sequence
  HCDR2
INTGGRA

SEQ ID NO: 1729 - protein, 15 aa, Artificial Sequence
  HCDR3
VRGAAGYPEYDDGDL

SEQ ID NO: 1730 - protein, 8 aa, Artificial Sequence
  LCDR1
PSVYHNNW

SEQ ID NO: 1731 - protein, 3 aa, Artificial Sequence
  LCDR2
EAS

SEQ ID NO: 1732 - protein, 10 aa, Artificial Sequence
  LCDR3
AGSFSDNIYT

SEQ ID NO: 1733 - protein, 8 aa, Artificial Sequence
  HCDR1
GFSLSGYD

SEQ ID NO: 1734 - protein, 6 aa, Artificial Sequence
  HCDR2
IYAGST

SEQ ID NO: 1735 - protein, 16 aa, Artificial Sequence
  HCDR3
TRVGAGYSGVWAYFNL

SEQ ID NO: 1736 - protein, 8 aa, Artificial Sequence
  LCDR1
QSVDSDNY

SEQ ID NO: 1737 - protein, 3 aa, Artificial Sequence
  LCDR2
DAS

SEQ ID NO: 1738 - protein, 12 aa, Artificial Sequence
  LCDR3
QGTYGNIGWYFA

SEQ ID NO: 1739 - protein, 8 aa, Artificial Sequence
  HCDR1
GIDLSSYT

SEQ ID NO: 1740 - protein, 7 aa, Artificial Sequence
  HCDR2
IGTSGTT

SEQ ID NO: 1741 - protein, 14 aa, Artificial Sequence
  HCDR3
ARLGDDYGDFHFNL

SEQ ID NO: 1742 - protein, 6 aa, Artificial Sequence
  LCDR1
QNIGNY

SEQ ID NO: 1743 - protein, 3 aa, Artificial Sequence
  LCDR2
AAS

SEQ ID NO: 1744 - protein, 11 aa, Artificial Sequence
  LCDR3
QCTYYDSTYFA

SEQ ID NO: 1745 - protein, 8 aa, Artificial Sequence
  HCDR1
GIDLSSSA

SEQ ID NO: 1746 - protein, 7 aa, Artificial Sequence
  HCDR2
IGYNDFT

SEQ ID NO: 1747 - protein, 15 aa, Artificial Sequence
  HCDR3
ARGGSSSYSDYVFDP

SEQ ID NO: 1748 - protein, 6 aa, Artificial Sequence
  LCDR1
QSIYSN

SEQ ID NO: 1749 - protein, 3 aa, Artificial Sequence
  LCDR2
DAS

SEQ ID NO: 1750 - protein, 12 aa, Artificial Sequence
  LCDR3
QSYYGISSYGVA

SEQ ID NO: 1751 - protein, 8 aa, Artificial Sequence
  HCDR1
GFSLSTYY

SEQ ID NO: 1752 - protein, 8 aa, Artificial Sequence
  HCDR2
IHGDDGST

SEQ ID NO: 1753 - protein, 15 aa, Artificial Sequence
  HCDR3
ARGLPYWPNDGDFNL

SEQ ID NO: 1754 - protein, 8 aa, Artificial Sequence
  LCDR1
QSVYNNNW

SEQ ID NO: 1755 - protein, 3 aa, Artificial Sequence
  LCDR2
GAS

SEQ ID NO: 1756 - protein, 11 aa, Artificial Sequence
  LCDR3
AGGYYTTSDNG

SEQ ID NO: 1757 - protein, 8 aa, Artificial Sequence
  HCDR1
GFSLSSYA

SEQ ID NO: 1758 - protein, 7 aa, Artificial Sequence
  HCDR2
INTAGGT

SEQ ID NO: 1759 - protein, 10 aa, Artificial Sequence
  HCDR3
ARYDYYYFDL

SEQ ID NO: 1760 - protein, 8 aa, Artificial Sequence
  LCDR1
QSVYDNNW

SEQ ID NO: 1761 - protein, 3 aa, Artificial Sequence
  LCDR2
SAS

SEQ ID NO: 1762 - protein, 10 aa, Artificial Sequence
  LCDR3
HGVYSGSIHA

SEQ ID NO: 1763 - protein, 8 aa, Artificial Sequence
  HCDR1
GFSLSNYY

SEQ ID NO: 1764 - protein, 7 aa, Artificial Sequence
  HCDR2
IGSGVST

SEQ ID NO: 1765 - protein, 14 aa, Artificial Sequence
  HCDR3
ARDMYVGNWGDWGL

SEQ ID NO: 1766 - protein, 6 aa, Artificial Sequence
  LCDR1
QSISNN

SEQ ID NO: 1767 - protein, 3 aa, Artificial Sequence
  LCDR2
SVS

SEQ ID NO: 1768 - protein, 12 aa, Artificial Sequence
  LCDR3
QQDYRIGDLDSA

SEQ ID NO: 1769 - protein, 9 aa, Artificial Sequence
  HCDR1
GFSFSNSYW

SEQ ID NO: 1770 - protein, 9 aa, Artificial Sequence
  HCDR2
IYLGSAGTT

SEQ ID NO: 1771 - protein, 14 aa, Artificial Sequence
  HCDR3
ARAGHDYWGAYHTL

SEQ ID NO: 1772 - protein, 6 aa, Artificial Sequence
  LCDR1
QNIDNT

SEQ ID NO: 1773 - protein, 3 aa, Artificial Sequence
  LCDR2
HAS

SEQ ID NO: 1774 - protein, 12 aa, Artificial Sequence
  LCDR3
QCPYYGSTYVYS

SEQ ID NO: 1775 - protein, 8 aa, Artificial Sequence
  HCDR1
GIDLSNHG

SEQ ID NO: 1776 - protein, 7 aa, Artificial Sequence
  HCDR2
IYIDGGA

SEQ ID NO: 1777 - protein, 17 aa, Artificial Sequence
  HCDR3
ARGIPSDGDSSYYYFNL

SEQ ID NO: 1778 - protein, 7 aa, Artificial Sequence
  LCDR1
QSVYNKY

SEQ ID NO: 1779 - protein, 3 aa, Artificial Sequence
  LCDR2
RAS

SEQ ID NO: 1780 - protein, 13 aa, Artificial Sequence
  LCDR3
QNNNGAGDNTDYT

SEQ ID NO: 1781 - protein, 8 aa, Artificial Sequence
  HCDR1
GFSLSRYA

SEQ ID NO: 1782 - protein, 7 aa, Artificial Sequence
  HCDR2
ISSSGTT

SEQ ID NO: 1783 - protein, 19 aa, Artificial Sequence
  HCDR3
ARAIAGDAGYVYAIDWLDL

SEQ ID NO: 1784 - protein, 6 aa, Artificial Sequence
  LCDR1
EYISNY

SEQ ID NO: 1785 - protein, 3 aa, Artificial Sequence
  LCDR2
GAS

SEQ ID NO: 1786 - protein, 13 aa, Artificial Sequence
  LCDR3
QGGYFSSSTTYVA

SEQ ID NO: 1787 - protein, 8 aa, Artificial Sequence
  HCDR1
GFTLSGYW

SEQ ID NO: 1788 - protein, 8 aa, Artificial Sequence
  HCDR2
IYNGDGST

SEQ ID NO: 1789 - protein, 12 aa, Artificial Sequence
  HCDR3
ARDSNGWGAYGL

SEQ ID NO: 1790 - protein, 6 aa, Artificial Sequence
  LCDR1
QSIGSY

SEQ ID NO: 1791 - protein, 3 aa, Artificial Sequence
  LCDR2
DAS

SEQ ID NO: 1792 - protein, 12 aa, Artificial Sequence
  LCDR3
QGGYYSSATEIA

SEQ ID NO: 1793 - protein, 8 aa, Artificial Sequence
  HCDR1
GFSLSSYA

SEQ ID NO: 1794 - protein, 7 aa, Artificial Sequence
  HCDR2
ISTSANT

SEQ ID NO: 1795 - protein, 22 aa, Artificial Sequence
  HCDR3
ARVVGLYDSYGDVDATYDAFDP

SEQ ID NO: 1796 - protein, 8 aa, Artificial Sequence
  LCDR1
QSVYNNNL

SEQ ID NO: 1797 - protein, 3 aa, Artificial Sequence
  LCDR2
DAS

SEQ ID NO: 1798 - protein, 12 aa, Artificial Sequence
  LCDR3
LGGYDDDADIYA

SEQ ID NO: 1799 - protein, 8 aa, Artificial Sequence
  HCDR1
GFSLNSYD

SEQ ID NO: 1800 - protein, 7 aa, Artificial Sequence
  HCDR2
ISASGSI

SEQ ID NO: 1801 - protein, 15 aa, Artificial Sequence
  HCDR3
ASDSYGWAYVYYFNL

SEQ ID NO: 1802 - protein, 6 aa, Artificial Sequence
  LCDR1
EDIGSY

SEQ ID NO: 1803 - protein, 3 aa, Artificial Sequence
  LCDR2
DAS

SEQ ID NO: 1804 - protein, 13 aa, Artificial Sequence
  LCDR3
QSAWYSSGTDKMA

SEQ ID NO: 1805 - protein, 9 aa, Artificial Sequence
  HCDR1
GFSFSSANC

SEQ ID NO: 1806 - protein, 8 aa, Artificial Sequence
  HCDR2
VCIGDGTT

SEQ ID NO: 1807 - protein, 6 aa, Artificial Sequence
  HCDR3
ARDLGL

SEQ ID NO: 1808 - protein, 8 aa, Artificial Sequence
  LCDR1
ESVDKYTQ

SEQ ID NO: 1809 - protein, 3 aa, Artificial Sequence
  LCDR2
YAS

SEQ ID NO: 1810 - protein, 12 aa, Artificial Sequence
  LCDR3
SGYKGGSADMIA

SEQ ID NO: 1811 - protein, 8 aa, Artificial Sequence
  HCDR1
GFSLSNYA

SEQ ID NO: 1812 - protein, 7 aa, Artificial Sequence
  HCDR2
ISGSGST

SEQ ID NO: 1813 - protein, 12 aa, Artificial Sequence
  HCDR3
GRGRDDDYAWDL

SEQ ID NO: 1814 - protein, 6 aa, Artificial Sequence
  LCDR1
QTISNY

SEQ ID NO: 1815 - protein, 3 aa, Artificial Sequence
  LCDR2
AAS

SEQ ID NO: 1816 - protein, 11 aa, Artificial Sequence
  LCDR3
HCTYYDSSYHG

SEQ ID NO: 1817 - protein, 9 aa, Artificial Sequence
  HCDR1
GFSFSSAYY

SEQ ID NO: 1818 - protein, 9 aa, Artificial Sequence
  HCDR2
IDAGSSGST

SEQ ID NO: 1819 - protein, 15 aa, Artificial Sequence
  HCDR3
ARDGGSTTGYGWLDL

SEQ ID NO: 1820 - protein, 7 aa, Artificial Sequence
  LCDR1
QSIGTNY

SEQ ID NO: 1821 - protein, 3 aa, Artificial Sequence
  LCDR2
EAS

SEQ ID NO: 1822 - protein, 12 aa, Artificial Sequence
  LCDR3
LYSYYSSSSAYT

SEQ ID NO: 1823 - protein, 8 aa, Artificial Sequence
  HCDR1
GFSLSTYN

SEQ ID NO: 1824 - protein, 7 aa, Artificial Sequence
  HCDR2
MAFDGNT

SEQ ID NO: 1825 - protein, 13 aa, Artificial Sequence
  HCDR3
CKGDPSSDTGTTL

SEQ ID NO: 1826 - protein, 8 aa, Artificial Sequence
  LCDR1
PSVYSNNW

SEQ ID NO: 1827 - protein, 3 aa, Artificial Sequence
  LCDR2
AAA

SEQ ID NO: 1828 - protein, 11 aa, Artificial Sequence
  LCDR3
AGGFNSDSDTT

SEQ ID NO: 1829 - protein, 8 aa, Artificial Sequence
  HCDR1
GFSLINYN

SEQ ID NO: 1830 - protein, 7 aa, Artificial Sequence
  HCDR2
ILTDGTV

SEQ ID NO: 1831 - protein, 12 aa, Artificial Sequence
  HCDR3
ARDYPSYIAFDL

SEQ ID NO: 1832 - protein, 8 aa, Artificial Sequence
  LCDR1
QSVYNDDN

SEQ ID NO: 1833 - protein, 3 aa, Artificial Sequence
  LCDR2
GAS

SEQ ID NO: 1834 - protein, 12 aa, Artificial Sequence
  LCDR3
QGGGFSSGWYWA

SEQ ID NO: 1835 - protein, 8 aa, Artificial Sequence
  HCDR1
GFSLSTYD

SEQ ID NO: 1836 - protein, 7 aa, Artificial Sequence
  HCDR2
IGGSGFT

SEQ ID NO: 1837 - protein, 7 aa, Artificial Sequence
  HCDR3
ARNNYDM

SEQ ID NO: 1838 - protein, 6 aa, Artificial Sequence
  LCDR1
QSISNE

SEQ ID NO: 1839 - protein, 3 aa, Artificial Sequence
  LCDR2
GAS

SEQ ID NO: 1840 - protein, 13 aa, Artificial Sequence
  LCDR3
QCTYYGSSYVGGA

SEQ ID NO: 1841 - protein, 8 aa, Artificial Sequence
  HCDR1
GFSLGSYP

SEQ ID NO: 1842 - protein, 8 aa, Artificial Sequence
  HCDR2
IDPGRGTT

SEQ ID NO: 1843 - protein, 12 aa, Artificial Sequence
  HCDR3
ARSYPGDGAGDL

SEQ ID NO: 1844 - protein, 6 aa, Artificial Sequence
  LCDR1
ESISNY

SEQ ID NO: 1845 - protein, 3 aa, Artificial Sequence
  LCDR2
GAS

SEQ ID NO: 1846 - protein, 13 aa, Artificial Sequence
  LCDR3
QCTYYGSGDVGGA

SEQ ID NO: 1847 - protein, 8 aa, Artificial Sequence
  HCDR1
GFDFSSGY

SEQ ID NO: 1848 - protein, 8 aa, Artificial Sequence
  HCDR2
IDPVFGST

SEQ ID NO: 1849 - protein, 16 aa, Artificial Sequence
  HCDR3
ARDLRAFYSGWGGINL

SEQ ID NO: 1850 - protein, 8 aa, Artificial Sequence
  LCDR1
QIVVNNNF

SEQ ID NO: 1851 - protein, 3 aa, Artificial Sequence
  LCDR2
DAS

SEQ ID NO: 1852 - protein, 11 aa, Artificial Sequence
  LCDR3
LGGYDDDAENA

SEQ ID NO: 1853 - protein, 8 aa, Artificial Sequence
  HCDR1
GFSLNSYD

SEQ ID NO: 1854 - protein, 7 aa, Artificial Sequence
  HCDR2
ISASGSI

SEQ ID NO: 1855 - protein, 15 aa, Artificial Sequence
  HCDR3
ASDSYGWAYVYYFNL

SEQ ID NO: 1856 - protein, 6 aa, Artificial Sequence
  LCDR1
EDIGSY

SEQ ID NO: 1857 - protein, 3 aa, Artificial Sequence
  LCDR2
DAS

SEQ ID NO: 1858 - protein, 13 aa, Artificial Sequence
  LCDR3
QSAWYSSNTDKMA

SEQ ID NO: 1859 - protein, 8 aa, Artificial Sequence
  HCDR1
EFSLSSNA

SEQ ID NO: 1860 - protein, 7 aa, Artificial Sequence
  HCDR2
IDSGGDA

SEQ ID NO: 1861 - protein, 11 aa, Artificial Sequence
  HCDR3
GRGYWFPRLGL

SEQ ID NO: 1862 - protein, 8 aa, Artificial Sequence
  LCDR1
KNVYLNNW

SEQ ID NO: 1863 - protein, 3 aa, Artificial Sequence
  LCDR2
DAS

SEQ ID NO: 1864 - protein, 11 aa, Artificial Sequence
  LCDR3
AGAYDDNSDHT

SEQ ID NO: 1865 - protein, 9 aa, Artificial Sequence
  HCDR1
GFSFNVDYY

SEQ ID NO: 1866 - protein, 9 aa, Artificial Sequence
  HCDR2
IYVGSEGST

SEQ ID NO: 1867 - protein, 20 aa, Artificial Sequence
  HCDR3
ARHYAGYAGYNYATDYYFTL

SEQ ID NO: 1868 - protein, 6 aa, Artificial Sequence
  LCDR1
QSVTNF

SEQ ID NO: 1869 - protein, 3 aa, Artificial Sequence
  LCDR2
GAS

SEQ ID NO: 1870 - protein, 8 aa, Artificial Sequence
  LCDR3
QSGYYSAT

SEQ ID NO: 1871 - protein, 8 aa, Artificial Sequence
  HCDR1
GFSLSSYA

SEQ ID NO: 1872 - protein, 7 aa, Artificial Sequence
  HCDR2
ISSGGNT

SEQ ID NO: 1873 - protein, 15 aa, Artificial Sequence
  HCDR3
ARGIHSYDDYLGYKL

SEQ ID NO: 1874 - protein, 6 aa, Artificial Sequence
  LCDR1
EFLFNA

SEQ ID NO: 1875 - protein, 3 aa, Artificial Sequence
  LCDR2
GAS

SEQ ID NO: 1876 - protein, 10 aa, Artificial Sequence
  LCDR3
LGGYKRADLT

SEQ ID NO: 1877 - protein, 8 aa, Artificial Sequence
  HCDR1
GFSLNDYA

SEQ ID NO: 1878 - protein, 7 aa, Artificial Sequence
  HCDR2
IYTSGTP

SEQ ID NO: 1879 - protein, 14 aa, Artificial Sequence
  HCDR3
ARQSGIDNYWLFTL

SEQ ID NO: 1880 - protein, 6 aa, Artificial Sequence
  LCDR1
ESIASG

SEQ ID NO: 1881 - protein, 3 aa, Artificial Sequence
  LCDR2
SAS

SEQ ID NO: 1882 - protein, 12 aa, Artificial Sequence
  LCDR3
QQGYTSTNLHNV

SEQ ID NO: 1883 - protein, 8 aa, Artificial Sequence
  HCDR1
GFSLSAYW

SEQ ID NO: 1884 - protein, 7 aa, Artificial Sequence
  HCDR2
IYATGST

SEQ ID NO: 1885 - protein, 11 aa, Artificial Sequence
  HCDR3
GRGDGYESLNL

SEQ ID NO: 1886 - protein, 8 aa, Artificial Sequence
  LCDR1
QSVYSNNL

SEQ ID NO: 1887 - protein, 3 aa, Artificial Sequence
  LCDR2
GAS

SEQ ID NO: 1888 - protein, 10 aa, Artificial Sequence
  LCDR3
LGYYSGGIYV

SEQ ID NO: 1889 - protein, 8 aa, Artificial Sequence
  HCDR1
GFSLSSYY

SEQ ID NO: 1890 - protein, 8 aa, Artificial Sequence
  HCDR2
IDTGSGDT

SEQ ID NO: 1891 - protein, 17 aa, Artificial Sequence
  HCDR3
ARVNPEFAHVWPYYFDL

SEQ ID NO: 1892 - protein, 7 aa, Artificial Sequence
  LCDR1
QSISSNF

SEQ ID NO: 1893 - protein, 3 aa, Artificial Sequence
  LCDR2
RAS

SEQ ID NO: 1894 - protein, 12 aa, Artificial Sequence
  LCDR3
QQGDSLSNVENA

SEQ ID NO: 1895 - protein, 8 aa, Artificial Sequence
  HCDR1
GFSLSNYN

SEQ ID NO: 1896 - protein, 7 aa, Artificial Sequence
  HCDR2
ISTDGSA

SEQ ID NO: 1897 - protein, 13 aa, Artificial Sequence
  HCDR3
ARLYYRHGYALNL

SEQ ID NO: 1898 - protein, 6 aa, Artificial Sequence
  LCDR1
QSVGSY

SEQ ID NO: 1899 - protein, 3 aa, Artificial Sequence
  LCDR2
SAS

SEQ ID NO: 1900 - protein, 14 aa, Artificial Sequence
  LCDR3
HCTYGSNITANWGT

SEQ ID NO: 1901 - protein, 8 aa, Artificial Sequence
  HCDR1
GFDFNNNA

SEQ ID NO: 1902 - protein, 9 aa, Artificial Sequence
  HCDR2
IYDGSSGST

SEQ ID NO: 1903 - protein, 16 aa, Artificial Sequence
  HCDR3
ARAYAAYTVYDYAFNL

SEQ ID NO: 1904 - protein, 6 aa, Artificial Sequence
  LCDR1
QSIGSD

SEQ ID NO: 1905 - protein, 3 aa, Artificial Sequence
  LCDR2
YTT

SEQ ID NO: 1906 - protein, 9 aa, Artificial Sequence
  LCDR3
QYADRSSYS

SEQ ID NO: 1907 - protein, 8 aa, Artificial Sequence
  HCDR1
GFSLSRYT

SEQ ID NO: 1908 - protein, 7 aa, Artificial Sequence
  HCDR2
IYGDDNT

SEQ ID NO: 1909 - protein, 15 aa, Artificial Sequence
  HCDR3
ASCAPIYYNTFSFNL

SEQ ID NO: 1910 - protein, 6 aa, Artificial Sequence
  LCDR1
QTIGGS

SEQ ID NO: 1911 - protein, 3 aa, Artificial Sequence
  LCDR2
AAA

SEQ ID NO: 1912 - protein, 12 aa, Artificial Sequence
  LCDR3
QQHYTGDNVNNP

SEQ ID NO: 1913 - protein, 8 aa, Artificial Sequence
  HCDR1
GFSLSRYH

SEQ ID NO: 1914 - protein, 7 aa, Artificial Sequence
  HCDR2
IHTDDTN

SEQ ID NO: 1915 - protein, 13 aa, Artificial Sequence
  HCDR3
ARVSSVGGYYFDL

SEQ ID NO: 1916 - protein, 6 aa, Artificial Sequence
  LCDR1
EDIYNL

SEQ ID NO: 1917 - protein, 3 aa, Artificial Sequence
  LCDR2
AAS

SEQ ID NO: 1918 - protein, 12 aa, Artificial Sequence
  LCDR3
QNNYLISSYGVG

SEQ ID NO: 1919 - protein, 8 aa, Artificial Sequence
  HCDR1
GFSLSGYD

SEQ ID NO: 1920 - protein, 6 aa, Artificial Sequence
  HCDR2
IYGGNT

SEQ ID NO: 1921 - protein, 16 aa, Artificial Sequence
  HCDR3
TRVGAGYSGVWAYFNL

SEQ ID NO: 1922 - protein, 8 aa, Artificial Sequence
  LCDR1
QSVDSDNY

SEQ ID NO: 1923 - protein, 3 aa, Artificial Sequence
  LCDR2
DTS

SEQ ID NO: 1924 - protein, 11 aa, Artificial Sequence
  LCDR3
QGTYYNGWYFA

SEQ ID NO: 1925 - protein, 8 aa, Artificial Sequence
  HCDR1
GFSLTNYA

SEQ ID NO: 1926 - protein, 7 aa, Artificial Sequence
  HCDR2
INYDGNT

SEQ ID NO: 1927 - protein, 16 aa, Artificial Sequence
  HCDR3
ARGGDGYTHIPDTFDP

SEQ ID NO: 1928 - protein, 6 aa, Artificial Sequence
  LCDR1
QSIYSY

SEQ ID NO: 1929 - protein, 3 aa, Artificial Sequence
  LCDR2
YAS

SEQ ID NO: 1930 - protein, 12 aa, Artificial Sequence
  LCDR3
QQGYSYSNIDNV

SEQ ID NO: 1931 - protein, 8 aa, Artificial Sequence
  HCDR1
GFDLSSYY

SEQ ID NO: 1932 - protein, 7 aa, Artificial Sequence
  HCDR2
IYTDSSA

SEQ ID NO: 1933 - protein, 13 aa, Artificial Sequence
  HCDR3
ARGLVVSTDNYNL

SEQ ID NO: 1934 - protein, 8 aa, Artificial Sequence
  LCDR1
QSIYNNNY

SEQ ID NO: 1935 - protein, 3 aa, Artificial Sequence
  LCDR2
YTS

SEQ ID NO: 1936 - protein, 10 aa, Artificial Sequence
  LCDR3
LGDVGGGMRV

SEQ ID NO: 1937 - protein, 8 aa, Artificial Sequence
  HCDR1
GFSLNNWV

SEQ ID NO: 1938 - protein, 9 aa, Artificial Sequence
  HCDR2
IDIVGSGST

SEQ ID NO: 1939 - protein, 12 aa, Artificial Sequence
  HCDR3
ARGVNGDGNLNL

SEQ ID NO: 1940 - protein, 6 aa, Artificial Sequence
  LCDR1
ETISNY

SEQ ID NO: 1941 - protein, 3 aa, Artificial Sequence
  LCDR2
GAS

SEQ ID NO: 1942 - protein, 11 aa, Artificial Sequence
  LCDR3
QCTYVGDSYTA

SEQ ID NO: 1943 - protein, 8 aa, Artificial Sequence
  HCDR1
GFSLSNYA

SEQ ID NO: 1944 - protein, 7 aa, Artificial Sequence
  HCDR2
ISPSGNT

SEQ ID NO: 1945 - protein, 19 aa, Artificial Sequence
  HCDR3
AREGALYDDYGDYVDAFDP

SEQ ID NO: 1946 - protein, 8 aa, Artificial Sequence
  LCDR1
ESVYNNNW

SEQ ID NO: 1947 - protein, 3 aa, Artificial Sequence
  LCDR2
RAS

SEQ ID NO: 1948 - protein, 12 aa, Artificial Sequence
  LCDR3
AGGYSSSSDINA

SEQ ID NO: 1949 - protein, 9 aa, Artificial Sequence
  HCDR1
GLSFSGSYW

SEQ ID NO: 1950 - protein, 9 aa, Artificial Sequence
  HCDR2
ITAGISGST

SEQ ID NO: 1951 - protein, 13 aa, Artificial Sequence
  HCDR3
ARERTGGWGDFNL

SEQ ID NO: 1952 - protein, 6 aa, Artificial Sequence
  LCDR1
QSITTY

SEQ ID NO: 1953 - protein, 3 aa, Artificial Sequence
  LCDR2
LAS

SEQ ID NO: 1954 - protein, 13 aa, Artificial Sequence
  LCDR3
QCTDGGINHWFWA

SEQ ID NO: 1955 - protein, 9 aa, Artificial Sequence
  HCDR1
GFSFSSGYD

SEQ ID NO: 1956 - protein, 8 aa, Artificial Sequence
  HCDR2
IDTATDTI

SEQ ID NO: 1957 - protein, 13 aa, Artificial Sequence
  HCDR3
ARSVGGVDYAIDL

SEQ ID NO: 1958 - protein, 6 aa, Artificial Sequence
  LCDR1
QNIGSR

SEQ ID NO: 1959 - protein, 3 aa, Artificial Sequence
  LCDR2
YAS

SEQ ID NO: 1960 - protein, 12 aa, Artificial Sequence
  LCDR3
QQTYSYSDVDDT

SEQ ID NO: 1961 - protein, 8 aa, Artificial Sequence
  HCDR1
GFSLSTYA

SEQ ID NO: 1962 - protein, 7 aa, Artificial Sequence
  HCDR2
IAGGGNT

SEQ ID NO: 1963 - protein, 12 aa, Artificial Sequence
  HCDR3
ARADYLGYGNNF

SEQ ID NO: 1964 - protein, 8 aa, Artificial Sequence
  LCDR1
QSVYNNNY

SEQ ID NO: 1965 - protein, 3 aa, Artificial Sequence
  LCDR2
WAS

SEQ ID NO: 1966 - protein, 11 aa, Artificial Sequence
  LCDR3
LGVYDDDADNG

SEQ ID NO: 1967 - protein, 8 aa, Artificial Sequence
  HCDR1
GFSLSSYA

SEQ ID NO: 1968 - protein, 7 aa, Artificial Sequence
  HCDR2
ISYDGST

SEQ ID NO: 1969 - protein, 12 aa, Artificial Sequence
  HCDR3
ARARIDDGYGNL

SEQ ID NO: 1970 - protein, 6 aa, Artificial Sequence
  LCDR1
ESISNY

SEQ ID NO: 1971 - protein, 3 aa, Artificial Sequence
  LCDR2
AAS

SEQ ID NO: 1972 - protein, 12 aa, Artificial Sequence
  LCDR3
QCTYVASTYVGT

SEQ ID NO: 1973 - protein, 8 aa, Artificial Sequence
  HCDR1
GFSLSTYY

SEQ ID NO: 1974 - protein, 7 aa, Artificial Sequence
  HCDR2
IYVRGGA

SEQ ID NO: 1975 - protein, 7 aa, Artificial Sequence
  HCDR3
AREGLSL

SEQ ID NO: 1976 - protein, 8 aa, Artificial Sequence
  LCDR1
QSVYKNNR

SEQ ID NO: 1977 - protein, 3 aa, Artificial Sequence
  LCDR2
ETS

SEQ ID NO: 1978 - protein, 13 aa, Artificial Sequence
  LCDR3
LGGYDCGSADCNA

SEQ ID NO: 1979 - protein, 9 aa, Artificial Sequence
  HCDR1
GFSLNNNYW

SEQ ID NO: 1980 - protein, 9 aa, Artificial Sequence
  HCDR2
IYVGVVSLT

SEQ ID NO: 1981 - protein, 20 aa, Artificial Sequence
  HCDR3
ARSLYSGYAGYGDGYYGMDL

SEQ ID NO: 1982 - protein, 6 aa, Artificial Sequence
  LCDR1
QSIGSD

SEQ ID NO: 1983 - protein, 3 aa, Artificial Sequence
  LCDR2
AAS

SEQ ID NO: 1984 - protein, 11 aa, Artificial Sequence
  LCDR3
QCTDYVDSHDT

SEQ ID NO: 1985 - protein, 8 aa, Artificial Sequence
  HCDR1
GIDLSSYA

SEQ ID NO: 1986 - protein, 7 aa, Artificial Sequence
  HCDR2
ISGSGNT

SEQ ID NO: 1987 - protein, 14 aa, Artificial Sequence
  HCDR3
CRGDPSYSIDGFDP

SEQ ID NO: 1988 - protein, 8 aa, Artificial Sequence
  LCDR1
QSVYNNND

SEQ ID NO: 1989 - protein, 3 aa, Artificial Sequence
  LCDR2
RAS

SEQ ID NO: 1990 - protein, 12 aa, Artificial Sequence
  LCDR3
LGAWDDDADTWA

SEQ ID NO: 1991 - protein, 8 aa, Artificial Sequence
  HCDR1
GFSLSNYY

SEQ ID NO: 1992 - protein, 7 aa, Artificial Sequence
  HCDR2
IDKSGSA

SEQ ID NO: 1993 - protein, 14 aa, Artificial Sequence
  HCDR3
ARGYGGYADHGLGL

SEQ ID NO: 1994 - protein, 6 aa, Artificial Sequence
  LCDR1
QSIAGW

SEQ ID NO: 1995 - protein, 3 aa, Artificial Sequence
  LCDR2
QAS

SEQ ID NO: 1996 - protein, 12 aa, Artificial Sequence
  LCDR3
QCTYGSASGSNG

SEQ ID NO: 1997 - protein, 8 aa, Artificial Sequence
  HCDR1
GFSLSSFA

SEQ ID NO: 1998 - protein, 7 aa, Artificial Sequence
  HCDR2
ISSSGTT

SEQ ID NO: 1999 - protein, 15 aa, Artificial Sequence
  HCDR3
ASHYDDYGDSDALDP

SEQ ID NO: 2000 - protein, 6 aa, Artificial Sequence
  LCDR1
EDIYSN

SEQ ID NO: 2001 - protein, 3 aa, Artificial Sequence
  LCDR2
RAS

SEQ ID NO: 2002 - protein, 11 aa, Artificial Sequence
  LCDR3
LGVDRHISDRA

SEQ ID NO: 2003 - protein, 8 aa, Artificial Sequence
  HCDR1
GFDFSYNS

SEQ ID NO: 2004 - protein, 8 aa, Artificial Sequence
  HCDR2
IYNGDGST

SEQ ID NO: 2005 - protein, 6 aa, Artificial Sequence
  HCDR3
TRDFGL

SEQ ID NO: 2006 - protein, 8 aa, Artificial Sequence
  LCDR1
ESVANHKQ

SEQ ID NO: 2007 - protein, 3 aa, Artificial Sequence
  LCDR2
YAS

SEQ ID NO: 2008 - protein, 12 aa, Artificial Sequence
  LCDR3
SGYKSISTDGNA

SEQ ID NO: 2009 - protein, 8 aa, Artificial Sequence
  HCDR1
GIDLSKYT

SEQ ID NO: 2010 - protein, 9 aa, Artificial Sequence
  HCDR2
ISFGGRGGT

SEQ ID NO: 2011 - protein, 15 aa, Artificial Sequence
  HCDR3
ARARYSGTNYDYFNL

SEQ ID NO: 2012 - protein, 6 aa, Artificial Sequence
  LCDR1
QSISNW

SEQ ID NO: 2013 - protein, 3 aa, Artificial Sequence
  LCDR2
GAS

SEQ ID NO: 2014 - protein, 12 aa, Artificial Sequence
  LCDR3
QQGYSSDGVTNA

SEQ ID NO: 2015 - protein, 8 aa, Artificial Sequence
  HCDR1
GIDLSSGA

SEQ ID NO: 2016 - protein, 8 aa, Artificial Sequence
  HCDR2
IYTGSGTT

SEQ ID NO: 2017 - protein, 14 aa, Artificial Sequence
  HCDR3
ARDAASSYWGHFTL

SEQ ID NO: 2018 - protein, 6 aa, Artificial Sequence
  LCDR1
ENIYSS

SEQ ID NO: 2019 - protein, 3 aa, Artificial Sequence
  LCDR2
RTS

SEQ ID NO: 2020 - protein, 14 aa, Artificial Sequence
  LCDR3
QSYYHNSGGGYDYG

SEQ ID NO: 2021 - protein, 9 aa, Artificial Sequence
  HCDR1
GFFFSGSYY

SEQ ID NO: 2022 - protein, 9 aa, Artificial Sequence
  HCDR2
IYTGSDDDT

SEQ ID NO: 2023 - protein, 13 aa, Artificial Sequence
  HCDR3
ARRNYDTDWGGDL

SEQ ID NO: 2024 - protein, 6 aa, Artificial Sequence
  LCDR1
QSIGSS

SEQ ID NO: 2025 - protein, 3 aa, Artificial Sequence
  LCDR2
YAS

SEQ ID NO: 2026 - protein, 12 aa, Artificial Sequence
  LCDR3
QCTYTSSDYLDA

SEQ ID NO: 2027 - protein, 8 aa, Artificial Sequence
  HCDR1
GFSFSYYW

SEQ ID NO: 2028 - protein, 8 aa, Artificial Sequence
  HCDR2
IGTGSGST

SEQ ID NO: 2029 - protein, 19 aa, Artificial Sequence
  HCDR3
ARDWGIYSSDAYYMDYFNL

SEQ ID NO: 2030 - protein, 6 aa, Artificial Sequence
  LCDR1
QSIGSY

SEQ ID NO: 2031 - protein, 3 aa, Artificial Sequence
  LCDR2
EAS

SEQ ID NO: 2032 - protein, 12 aa, Artificial Sequence
  LCDR3
QQGGISTNVQNA

SEQ ID NO: 2033 - protein, 8 aa, Artificial Sequence
  HCDR1
GFTFSSHA

SEQ ID NO: 2034 - protein, 7 aa, Artificial Sequence
  HCDR2
IYDDGTT

SEQ ID NO: 2035 - protein, 10 aa, Artificial Sequence
  HCDR3
LRGYNSGFNF

SEQ ID NO: 2036 - protein, 8 aa, Artificial Sequence
  LCDR1
ESVYNNNF

SEQ ID NO: 2037 - protein, 3 aa, Artificial Sequence
  LCDR2
LAS

SEQ ID NO: 2038 - protein, 10 aa, Artificial Sequence
  LCDR3
AGGYDDNVYG

SEQ ID NO: 2039 - protein, 8 aa, Artificial Sequence
  HCDR1
GFSFSNNA

SEQ ID NO: 2040 - protein, 9 aa, Artificial Sequence
  HCDR2
IYDGSSGST

SEQ ID NO: 2041 - protein, 16 aa, Artificial Sequence
  HCDR3
ARAYGGYTVYDYAFNL

SEQ ID NO: 2042 - protein, 6 aa, Artificial Sequence
  LCDR1
QSIGSD

SEQ ID NO: 2043 - protein, 3 aa, Artificial Sequence
  LCDR2
YTT

SEQ ID NO: 2044 - protein, 9 aa, Artificial Sequence
  LCDR3
QYGVRSTYS

SEQ ID NO: 2045 - protein, 8 aa, Artificial Sequence
  HCDR1
GFSLSSYA

SEQ ID NO: 2046 - protein, 7 aa, Artificial Sequence
  HCDR2
IDTDGSA

SEQ ID NO: 2047 - protein, 15 aa, Artificial Sequence
  HCDR3
AGDSYGYAGFVYFNL

SEQ ID NO: 2048 - protein, 6 aa, Artificial Sequence
  LCDR1
QNIYSS

SEQ ID NO: 2049 - protein, 3 aa, Artificial Sequence
  LCDR2
DAS

SEQ ID NO: 2050 - protein, 12 aa, Artificial Sequence
  LCDR3
QCSYYGVDYVGG

SEQ ID NO: 2051 - protein, 8 aa, Artificial Sequence
  HCDR1
GIDLSRWT

SEQ ID NO: 2052 - protein, 7 aa, Artificial Sequence
  HCDR2
IYASDDT

SEQ ID NO: 2053 - protein, 13 aa, Artificial Sequence
  HCDR3
VRVYGSTSGYYDL

SEQ ID NO: 2054 - protein, 6 aa, Artificial Sequence
  LCDR1
QSISNW

SEQ ID NO: 2055 - protein, 3 aa, Artificial Sequence
  LCDR2
YAS

SEQ ID NO: 2056 - protein, 12 aa, Artificial Sequence
  LCDR3
QNFGDGNSIGHA

SEQ ID NO: 2057 - protein, 8 aa, Artificial Sequence
  HCDR1
GFSLSNYY

SEQ ID NO: 2058 - protein, 7 aa, Artificial Sequence
  HCDR2
IDKSGSA

SEQ ID NO: 2059 - protein, 14 aa, Artificial Sequence
  HCDR3
ARGYGGYADHGLGL

SEQ ID NO: 2060 - protein, 6 aa, Artificial Sequence
  LCDR1
QSIAGW

SEQ ID NO: 2061 - protein, 3 aa, Artificial Sequence
  LCDR2
QAS

SEQ ID NO: 2062 - protein, 12 aa, Artificial Sequence
  LCDR3
QCTYGSGSGSNG

SEQ ID NO: 2063 - protein, 8 aa, Artificial Sequence
  HCDR1
GIDLSINV

SEQ ID NO: 2064 - protein, 7 aa, Artificial Sequence
  HCDR2
ISSHGDT

SEQ ID NO: 2065 - protein, 11 aa, Artificial Sequence
  HCDR3
ARYVGDGYYDL

SEQ ID NO: 2066 - protein, 6 aa, Artificial Sequence
  LCDR1
QSISNL

SEQ ID NO: 2067 - protein, 3 aa, Artificial Sequence
  LCDR2
DTS

SEQ ID NO: 2068 - protein, 12 aa, Artificial Sequence
  LCDR3
QQSYSSSNIANL

SEQ ID NO: 2069 - protein, 8 aa, Artificial Sequence
  HCDR1
GFSLRHYA

SEQ ID NO: 2070 - protein, 7 aa, Artificial Sequence
  HCDR2
ITTTANT

SEQ ID NO: 2071 - protein, 22 aa, Artificial Sequence
  HCDR3
ARAMGLYDSYVDVDDTHDAFDP

SEQ ID NO: 2072 - protein, 8 aa, Artificial Sequence
  LCDR1
QSVYNSHV

SEQ ID NO: 2073 - protein, 3 aa, Artificial Sequence
  LCDR2
DAS

SEQ ID NO: 2074 - protein, 13 aa, Artificial Sequence
  LCDR3
LGGYDDDADNIFA

SEQ ID NO: 2075 - protein, 9 aa, Artificial Sequence
  HCDR1
GFSFSSGYD

SEQ ID NO: 2076 - protein, 8 aa, Artificial Sequence
  HCDR2
IDTGTGTI

SEQ ID NO: 2077 - protein, 13 aa, Artificial Sequence
  HCDR3
ARSVGGYDYAIDL

SEQ ID NO: 2078 - protein, 6 aa, Artificial Sequence
  LCDR1
QNIGSR

SEQ ID NO: 2079 - protein, 3 aa, Artificial Sequence
  LCDR2
YAS

SEQ ID NO: 2080 - protein, 12 aa, Artificial Sequence
  LCDR3
QQTYSYSDVDDT

SEQ ID NO: 2081 - protein, 8 aa, Artificial Sequence
  HCDR1
GIDLSSYA

SEQ ID NO: 2082 - protein, 7 aa, Artificial Sequence
  HCDR2
ISYDGST

SEQ ID NO: 2083 - protein, 12 aa, Artificial Sequence
  HCDR3
ARVDYGDYNFAL

SEQ ID NO: 2084 - protein, 6 aa, Artificial Sequence
  LCDR1
ESISNY

SEQ ID NO: 2085 - protein, 3 aa, Artificial Sequence
  LCDR2
AAS

SEQ ID NO: 2086 - protein, 11 aa, Artificial Sequence
  LCDR3
QCTYYVSSYFA

SEQ ID NO: 2087 - protein, 8 aa, Artificial Sequence
  HCDR1
AFSLNHYN

SEQ ID NO: 2088 - protein, 7 aa, Artificial Sequence
  HCDR2
ILTDGTE

SEQ ID NO: 2089 - protein, 11 aa, Artificial Sequence
  HCDR3
AREGDWGVDSL

SEQ ID NO: 2090 - protein, 8 aa, Artificial Sequence
  LCDR1
QSVDNNDF

SEQ ID NO: 2091 - protein, 3 aa, Artificial Sequence
  LCDR2
LAS

SEQ ID NO: 2092 - protein, 12 aa, Artificial Sequence
  LCDR3
KGLYFDSGWYAA

SEQ ID NO: 2093 - protein, 8 aa, Artificial Sequence
  HCDR1
GFSLSSYD

SEQ ID NO: 2094 - protein, 7 aa, Artificial Sequence
  HCDR2
IYVSGTT

SEQ ID NO: 2095 - protein, 14 aa, Artificial Sequence
  HCDR3
ARDIYVDEIGCFDL

SEQ ID NO: 2096 - protein, 6 aa, Artificial Sequence
  LCDR1
QNIRTY

SEQ ID NO: 2097 - protein, 3 aa, Artificial Sequence
  LCDR2
RAS

SEQ ID NO: 2098 - protein, 10 aa, Artificial Sequence
  LCDR3
QNYDGGSSTG

SEQ ID NO: 2099 - protein, 8 aa, Artificial Sequence
  HCDR1
GIDLSSAD

SEQ ID NO: 2100 - protein, 7 aa, Artificial Sequence
  HCDR2
INNVGSA

SEQ ID NO: 2101 - protein, 8 aa, Artificial Sequence
  HCDR3
VRGYWLDL

SEQ ID NO: 2102 - protein, 8 aa, Artificial Sequence
  LCDR1
VNVYNNNY

SEQ ID NO: 2103 - protein, 3 aa, Artificial Sequence
  LCDR2
AAS

SEQ ID NO: 2104 - protein, 11 aa, Artificial Sequence
  LCDR3
VGYYSSTDDNG

SEQ ID NO: 2105 - protein, 8 aa, Artificial Sequence
  HCDR1
GFTLSSYY

SEQ ID NO: 2106 - protein, 7 aa, Artificial Sequence
  HCDR2
IYPSGSA

SEQ ID NO: 2107 - protein, 14 aa, Artificial Sequence
  HCDR3
ARSTTSSLYYGYNL

SEQ ID NO: 2108 - protein, 6 aa, Artificial Sequence
  LCDR1
ASITNW

SEQ ID NO: 2109 - protein, 3 aa, Artificial Sequence
  LCDR2
KAS

SEQ ID NO: 2110 - protein, 13 aa, Artificial Sequence
  LCDR3
QSNYGGGSDTSHT

SEQ ID NO: 2111 - protein, 8 aa, Artificial Sequence
  HCDR1
GIDLNICG

SEQ ID NO: 2112 - protein, 7 aa, Artificial Sequence
  HCDR2
IYPSDYT

SEQ ID NO: 2113 - protein, 13 aa, Artificial Sequence
  HCDR3
ARGLGHAWSHFDL

SEQ ID NO: 2114 - protein, 6 aa, Artificial Sequence
  LCDR1
QSIGSD

SEQ ID NO: 2115 - protein, 3 aa, Artificial Sequence
  LCDR2
SVS

SEQ ID NO: 2116 - protein, 13 aa, Artificial Sequence
  LCDR3
QSYYGTITTGYIA

SEQ ID NO: 2117 - protein, 8 aa, Artificial Sequence
  HCDR1
GFSLNSYD

SEQ ID NO: 2118 - protein, 7 aa, Artificial Sequence
  HCDR2
ISASGSI

SEQ ID NO: 2119 - protein, 15 aa, Artificial Sequence
  HCDR3
ASDSYGWAYVYYFNL

SEQ ID NO: 2120 - protein, 6 aa, Artificial Sequence
  LCDR1
EDVGSY

SEQ ID NO: 2121 - protein, 3 aa, Artificial Sequence
  LCDR2
DAS

SEQ ID NO: 2122 - protein, 13 aa, Artificial Sequence
  LCDR3
QSAWLGTNTDKMA

SEQ ID NO: 2123 - protein, 8 aa, Artificial Sequence
  HCDR1
GFDLSSYA

SEQ ID NO: 2124 - protein, 7 aa, Artificial Sequence
  HCDR2
IYGSGST

SEQ ID NO: 2125 - protein, 13 aa, Artificial Sequence
  HCDR3
ARGLVASTDNYNL

SEQ ID NO: 2126 - protein, 8 aa, Artificial Sequence
  LCDR1
QSVYNNNY

SEQ ID NO: 2127 - protein, 3 aa, Artificial Sequence
  LCDR2
LAS

SEQ ID NO: 2128 - protein, 10 aa, Artificial Sequence
  LCDR3
LGDVGGGERV

SEQ ID NO: 2129 - protein, 8 aa, Artificial Sequence
  HCDR1
GFSLSNYH

SEQ ID NO: 2130 - protein, 8 aa, Artificial Sequence
  HCDR2
ITTADETT

SEQ ID NO: 2131 - protein, 13 aa, Artificial Sequence
  HCDR3
GRTIRYDDYAVDL

SEQ ID NO: 2132 - protein, 6 aa, Artificial Sequence
  LCDR1
ESVGGY

SEQ ID NO: 2133 - protein, 3 aa, Artificial Sequence
  LCDR2
AAG

SEQ ID NO: 2134 - protein, 11 aa, Artificial Sequence
  LCDR3
QCTYFDSSYVG

SEQ ID NO: 2135 - protein, 8 aa, Artificial Sequence
  HCDR1
GFSLIKSH

SEQ ID NO: 2136 - protein, 7 aa, Artificial Sequence
  HCDR2
IAYDDNT

SEQ ID NO: 2137 - protein, 13 aa, Artificial Sequence
  HCDR3
AREDSSGWGSFNL

SEQ ID NO: 2138 - protein, 8 aa, Artificial Sequence
  LCDR1
QSVYATNQ

SEQ ID NO: 2139 - protein, 3 aa, Artificial Sequence
  LCDR2
SAS

SEQ ID NO: 2140 - protein, 13 aa, Artificial Sequence
  LCDR3
QGAYDCSGGDCRA

SEQ ID NO: 2141 - protein, 8 aa, Artificial Sequence
  HCDR1
GIDLSRYA

SEQ ID NO: 2142 - protein, 7 aa, Artificial Sequence
  HCDR2
IDDNDIT

SEQ ID NO: 2143 - protein, 13 aa, Artificial Sequence
  HCDR3
ARTADYADYSFGL

SEQ ID NO: 2144 - protein, 6 aa, Artificial Sequence
  LCDR1
ENIGNY

SEQ ID NO: 2145 - protein, 3 aa, Artificial Sequence
  LCDR2
AAS

SEQ ID NO: 2146 - protein, 11 aa, Artificial Sequence
  LCDR3
QCTYDDSEYFV

SEQ ID NO: 2147 - protein, 8 aa, Artificial Sequence
  HCDR1
GIDFSSYW

SEQ ID NO: 2148 - protein, 8 aa, Artificial Sequence
  HCDR2
IYNGDGST

SEQ ID NO: 2149 - protein, 6 aa, Artificial Sequence
  HCDR3
ARDFHL

SEQ ID NO: 2150 - protein, 8 aa, Artificial Sequence
  LCDR1
QNIYKNNY

SEQ ID NO: 2151 - protein, 3 aa, Artificial Sequence
  LCDR2
SAS

SEQ ID NO: 2152 - protein, 13 aa, Artificial Sequence
  LCDR3
LGSVACSGPDCIV

SEQ ID NO: 2153 - protein, 8 aa, Artificial Sequence
  HCDR1
GIDFSSYG

SEQ ID NO: 2154 - protein, 8 aa, Artificial Sequence
  HCDR2
TYPDYGST

SEQ ID NO: 2155 - protein, 15 aa, Artificial Sequence
  HCDR3
ASSSNGWGGGFYFDL

SEQ ID NO: 2156 - protein, 6 aa, Artificial Sequence
  LCDR1
EDIYSN

SEQ ID NO: 2157 - protein, 3 aa, Artificial Sequence
  LCDR2
GAS

SEQ ID NO: 2158 - protein, 13 aa, Artificial Sequence
  LCDR3
LGVYTYITTDPNA

SEQ ID NO: 2159 - protein, 8 aa, Artificial Sequence
  HCDR1
GIDFNNYY

SEQ ID NO: 2160 - protein, 8 aa, Artificial Sequence
  HCDR2
IYTGSGST

SEQ ID NO: 2161 - protein, 24 aa, Artificial Sequence
  HCDR3
ARPEFYDTYGYAGYGYATPNYFNF

SEQ ID NO: 2162 - protein, 8 aa, Artificial Sequence
  LCDR1
QSVYNNNL

SEQ ID NO: 2163 - protein, 3 aa, Artificial Sequence
  LCDR2
DAS

SEQ ID NO: 2164 - protein, 12 aa, Artificial Sequence
  LCDR3
LGGYDDDADYNA

SEQ ID NO: 2165 - protein, 8 aa, Artificial Sequence
  HCDR1
GFSLSSST

SEQ ID NO: 2166 - protein, 7 aa, Artificial Sequence
  HCDR2
IYTDGDT

SEQ ID NO: 2167 - protein, 12 aa, Artificial Sequence
  HCDR3
ARRANGYDDFDP

SEQ ID NO: 2168 - protein, 6 aa, Artificial Sequence
  LCDR1
ESISSY

SEQ ID NO: 2169 - protein, 3 aa, Artificial Sequence
  LCDR2
YES

SEQ ID NO: 2170 - protein, 12 aa, Artificial Sequence
  LCDR3
QQGFSYINVDNT

SEQ ID NO: 2171 - protein, 8 aa, Artificial Sequence
  HCDR1
GFSLNMFY

SEQ ID NO: 2172 - protein, 7 aa, Artificial Sequence
  HCDR2
IDSMGSA

SEQ ID NO: 2173 - protein, 12 aa, Artificial Sequence
  HCDR3
ARAINGDGAGDL

SEQ ID NO: 2174 - protein, 6 aa, Artificial Sequence
  LCDR1
EKIDSF

SEQ ID NO: 2175 - protein, 3 aa, Artificial Sequence
  LCDR2
GAS

SEQ ID NO: 2176 - protein, 12 aa, Artificial Sequence
  LCDR3
QSTADGSDYVGT

SEQ ID NO: 2177 - protein, 8 aa, Artificial Sequence
  HCDR1
GIDLSSNA

SEQ ID NO: 2178 - protein, 7 aa, Artificial Sequence
  HCDR2
IFPGDNI

SEQ ID NO: 2179 - protein, 11 aa, Artificial Sequence
  HCDR3
ARYHADDSVDL

SEQ ID NO: 2180 - protein, 6 aa, Artificial Sequence
  LCDR1
QSINGW

SEQ ID NO: 2181 - protein, 3 aa, Artificial Sequence
  LCDR2
RAS

SEQ ID NO: 2182 - protein, 12 aa, Artificial Sequence
  LCDR3
HLGDIYSNIDYV

SEQ ID NO: 2183 - protein, 8 aa, Artificial Sequence
  HCDR1
GFSLNSYD

SEQ ID NO: 2184 - protein, 7 aa, Artificial Sequence
  HCDR2
ISAIDNT

SEQ ID NO: 2185 - protein, 15 aa, Artificial Sequence
  HCDR3
ASDSYGWAYVYYFNL

SEQ ID NO: 2186 - protein, 6 aa, Artificial Sequence
  LCDR1
EDIGSY

SEQ ID NO: 2187 - protein, 3 aa, Artificial Sequence
  LCDR2
DAS

SEQ ID NO: 2188 - protein, 13 aa, Artificial Sequence
  LCDR3
QSAWYSSDSDKMA

SEQ ID NO: 2189 - protein, 8 aa, Artificial Sequence
  HCDR1
GFSLSTYG

SEQ ID NO: 2190 - protein, 7 aa, Artificial Sequence
  HCDR2
IDGGDSP

SEQ ID NO: 2191 - protein, 13 aa, Artificial Sequence
  HCDR3
ARIAGSNHGPFDL

SEQ ID NO: 2192 - protein, 6 aa, Artificial Sequence
  LCDR1
EFISNY

SEQ ID NO: 2193 - protein, 3 aa, Artificial Sequence
  LCDR2
GAS

SEQ ID NO: 2194 - protein, 11 aa, Artificial Sequence
  LCDR3
QCTAYGSSYVG

SEQ ID NO: 2195 - protein, 8 aa, Artificial Sequence
  HCDR1
GFSLSSYA

SEQ ID NO: 2196 - protein, 7 aa, Artificial Sequence
  HCDR2
INSYATT

SEQ ID NO: 2197 - protein, 9 aa, Artificial Sequence
  HCDR3
AREAGYADL

SEQ ID NO: 2198 - protein, 6 aa, Artificial Sequence
  LCDR1
QSISRY

SEQ ID NO: 2199 - protein, 3 aa, Artificial Sequence
  LCDR2
EAS

SEQ ID NO: 2200 - protein, 12 aa, Artificial Sequence
  LCDR3
QQDYDSTDVGNT

SEQ ID NO: 2201 - protein, 9 aa, Artificial Sequence
  HCDR1
GFSFSSGYY

SEQ ID NO: 2202 - protein, 8 aa, Artificial Sequence
  HCDR2
IYSGSDSA

SEQ ID NO: 2203 - protein, 16 aa, Artificial Sequence
  HCDR3
VRDLGDYNALSYTINL

SEQ ID NO: 2204 - protein, 6 aa, Artificial Sequence
  LCDR1
QSISTN

SEQ ID NO: 2205 - protein, 3 aa, Artificial Sequence
  LCDR2
RAS

SEQ ID NO: 2206 - protein, 11 aa, Artificial Sequence
  LCDR3
QCIDYDDYGGT

SEQ ID NO: 2207 - protein, 8 aa, Artificial Sequence
  HCDR1
GFSLSDYY

SEQ ID NO: 2208 - protein, 7 aa, Artificial Sequence
  HCDR2
MNSGGNA

SEQ ID NO: 2209 - protein, 9 aa, Artificial Sequence
  HCDR3
VRDLSRFSL

SEQ ID NO: 2210 - protein, 7 aa, Artificial Sequence
  LCDR1
PSVYSDY

SEQ ID NO: 2211 - protein, 3 aa, Artificial Sequence
  LCDR2
WAS

SEQ ID NO: 2212 - protein, 12 aa, Artificial Sequence
  LCDR3
AGGYSGNSDVWA

SEQ ID NO: 2213 - protein, 9 aa, Artificial Sequence
  HCDR1
GFSFDIDYY

SEQ ID NO: 2214 - protein, 9 aa, Artificial Sequence
  HCDR2
IYAGSSGST

SEQ ID NO: 2215 - protein, 20 aa, Artificial Sequence
  HCDR3
ARHYAGYAGDAYATDYYFNL

SEQ ID NO: 2216 - protein, 6 aa, Artificial Sequence
  LCDR1
QSVSNF

SEQ ID NO: 2217 - protein, 3 aa, Artificial Sequence
  LCDR2
GAS

SEQ ID NO: 2218 - protein, 8 aa, Artificial Sequence
  LCDR3
QSGYYSAT

SEQ ID NO: 2219 - protein, 9 aa, Artificial Sequence
  HCDR1
GFDLSSYYY

SEQ ID NO: 2220 - protein, 9 aa, Artificial Sequence
  HCDR2
FYTDDSANT

SEQ ID NO: 2221 - protein, 12 aa, Artificial Sequence
  HCDR3
ARDASGWYWFNL

SEQ ID NO: 2222 - protein, 8 aa, Artificial Sequence
  LCDR1
QSLHDDNA

SEQ ID NO: 2223 - protein, 3 aa, Artificial Sequence
  LCDR2
LAS

SEQ ID NO: 2224 - protein, 10 aa, Artificial Sequence
  LCDR3
QGAYSGDNNS

SEQ ID NO: 2225 - protein, 117 aa, Artificial Sequence
  VH
QSVEESGGRLVTPGTPLTLTCTVSGFSLSSYAVSWVRQAPGKGLEWIGVIWNNGATHYATWAKGRFTISKASTTVDLKVTSPTTEDTATYFCARSANDAWSTYSDLWGQGTLVTVSS

SEQ ID NO: 2226 - protein, 112 aa, Artificial Sequence
  VL
DIVMTQTPASVEAAVGGTVTIKCQASQTITNYLSWYQQKPGQPPKLLIYKASTLTSGVSSRFKGSGSGTEFTLTISDLESDDAATYYCQNYYYGSSSGYGFVFGGGTEVVVK

SEQ ID NO: 2227 - protein, 117 aa, Artificial Sequence
  VH
QSVEESGGRLVTPGTPLTLTCTVSGFSLTYYAVTWVRQPPGKGLEWIGVIYDNGATAFATWAKGRFTMSKNSTTVALKVTSPTTEDTATYFCARSANNAWSTYSNLWGQGTLVTVSS

SEQ ID NO: 2228 - protein, 112 aa, Artificial Sequence
  VL
DIVMTQTPSSVSAAVGGTVTINCQASEDISSYLSWYQQKLGQPPKLLIYKASTLESGVPSRFKGSGSGTEYTLTISDLESDDAATYYCQSYYSGSISGYGFVFGGGTGVVVK

SEQ ID NO: 2229 - protein, 121 aa, Artificial Sequence
  VH
QSVEESGGRLVTPGTPLTLTCTASGFTISSYHMIWVRQAPGEGLEWIGDIYGGTATTDYASWAKGRFTISKTSTTVDLKMTSLTTEDTATYFCARARYSGGSYANYVFNLWGQGTLVTVSS

SEQ ID NO: 2230 - protein, 112 aa, Artificial Sequence
  VL
DIVMTQTPASVEAAVGGTVTIKCQASQSISSYLAWYQQKPGQPPKLLIYRTSTLESGVPSRFKGSGSGTEFTLTISDLESADAATYYCQGYDWSSSNRYDNTFGGGTEVVVK

SEQ ID NO: 2231 - protein, 114 aa, Artificial Sequence
  VH
QSLEESGGRLVTPGTPLTLTCTASGFSLSRYDMSWVRQAPGKGLEYIGVISSSGGTNYANWAKGRFTISKTSTTVDLKITSPTTEDTATYFCAREGDYWDFNLWGPGTLVTVSS

SEQ ID NO: 2232 - protein, 110 aa, Artificial Sequence
  VL
AQVLTQTPSSVSAAVGGTVTINCQASQSISNLLAWYQQKPGQPPKLLIYGASTLASGVPSRFSGSGSGTEFTLTISDLESDDAATYYCAGGFPGLDTVAAFGGGTEAVVT

SEQ ID NO: 2233 - protein, 119 aa, Artificial Sequence
  VH
QSVEESGGRLVTPGTPLTLTCTASGFTISDFHVTWVRQAPGKGLEWIGTIITSASTTAYATWARGRFTISKSSTTVNLKIVSPTTEDTATYFCARSTYTDTSGYYFDFWGQGTLVTVSS

SEQ ID NO: 2234 - protein, 113 aa, Artificial Sequence
  VL
AQVLTQTASPVSAAVGGTVIINCQSSQSIYNGNRLSWYQQKPGQPPKLLIYSASTLASGVSSRFKGSGSGTQFTLAISDVQSDDAATYYCLGSYDCDSADCFAFGGGTEVVVE

SEQ ID NO: 2235 - protein, 118 aa, Artificial Sequence
  VH
QSVEESGGRLVTPGTPLTLTCTVSGFSLSSYAMSWVRQAPGKGLEWIGIISTSGITYYASWAKGRFTISKTSTMVDLKITSPTTEDTATYFCARLNGFDDYVRYFDFWGLGTLVTVSS

SEQ ID NO: 2236 - protein, 110 aa, Artificial Sequence
  VL
AIELTQTPSSVSAAVGGTVTINCQASESIASNLAWYQQKPGQPPKLLIYAASYLASGVPSRFKGSGSGTEYTLTISGVQSADAATYYCQSAFYVSSSDNAFGGGTEVVVK

SEQ ID NO: 2237 - protein, 115 aa, Artificial Sequence
  VH
QSLEESGGRLVTPGTPLTLTCTASGFSLSSYDVSWVRQAPGKGLEYIGFIGSDGSAHYATWVKGRFTISKTSTTVDLKITSPTTEDTATYFCARDWNDYWAHDLWGPGTLVTVSS

SEQ ID NO: 2238 - protein, 112 aa, Artificial Sequence
  VL
AQVLTQTTSPVSAAVGGTVTINCQASQIVTSKSALSWYQQKPGQPPRLLIYKASTLASGVPSRFSGSGSGTQFTLTISDLESDDAATYYCAGGYYNSGDLNPFGGGTEVVVK

SEQ ID NO: 2239 - protein, 114 aa, Artificial Sequence
  VH
QSLEESGGRLVTPGTPLTLTCTASGFSLSSYDMSWVRQAPGKGLEYIGYISSSGNTYYASWAKSRFTISKTSTTVDLKITSPTTEDTATYFCAREGDYWDFNLWGPGTLVTVSS

SEQ ID NO: 2240 - protein, 110 aa, Artificial Sequence
  VL
AQVLTQTPSSVSAAVGGTVTINCQASQSISNLLAWYQQKPGQRPRLLIYRASTLASGVPSRFKGSGSGTEFTLTISDLESEDAATYYCAGGFPGLDTGATFGGGTEAVVT

SEQ ID NO: 2241 - protein, 114 aa, Artificial Sequence
  VH
QSLEESGGRLVTPGTPLTLTCTVSGFSLNDYWMSWVRQAPGKGLEWIGYIDVGGSLYYASWAKGRFTISRTSTTVDLKMTSLTTEDTATYFCARGGLTYGFDLWGPGTLVTVSS

SEQ ID NO: 2242 - protein, 110 aa, Artificial Sequence
  VL
DIVMTQTPASVSEPVGGTVTINCQASEDISSYLAWYQQKPGQRPKRLIYGASDLASGVPSRFSASGSGTEYALTISDLESADAATYYCHYYATISGLGVAFGGGTEVVVK

SEQ ID NO: 2243 - protein, 117 aa, Artificial Sequence
  VH
QSVEESGGRLVTPGTPLTLTCTVSGFSLSTYAMIWVRQAPGKGLEWIGVVYDNGYISHATWVKGRFTISKTSTTVGLEITSPTTEDTATYFCARSADGSWSTYFNLWGQGTLVTVSS

SEQ ID NO: 2244 - protein, 112 aa, Artificial Sequence
  VL
DIVMTQTPASVEAAVGGTVTIKCQASESISNYLAWYQQKPGQPPKLLIYKASTLASGVSSRFKGSGSGTEFTLTISDLESADAATYYCQTNYCCSSSDNGFAFGGGTEVVVK

SEQ ID NO: 2245 - protein, 115 aa, Artificial Sequence
  VH
QSLEESGGRLVTPGTPLTLTCTVSGIDLSSYHMCWVRQAPGKGLEYIGYIAYGGNTYYANWAKGRFTISKTSTTVDLRITSPTTEDTATYFCARGYSEDSYWGLWGPGTLVTVSS

SEQ ID NO: 2246 - protein, 110 aa, Artificial Sequence
  VL
AYDMTQTPASVEAAVGGTVTIKCQASQNIENYLAWYQQKPGQPPKLLIYDTSKLTSGVPSRFSGSGSGTDFTLTISGVQSDDAATYYCQQDYGIIFVDNIFGGGTEVVVK

SEQ ID NO: 2247 - protein, 122 aa, Artificial Sequence
  VH
QSVEESGGRLVTPGTPLTLTCTVSGFSLSDYYMTWVRQAPGKGLEYIGIMSGSGSTYYASWAKGRFTISKTSSTTLELKITSPTTEDTAIYFCARDGDYAGWGYATGAFDPWGPGTLVTVSS

SEQ ID NO: 2248 - protein, 112 aa, Artificial Sequence
  VL
AAVLTQTPSPVSAAVGGTVTISCQASQSVVGNSLLSWFQKKPGQPPKLLIYSASSLASGVPSRFKGSGSGTQFTLTISDLESDDAATYYCTGRYNSDTDTFVFGGGTEVVVK

SEQ ID NO: 2249 - protein, 8 aa, Artificial Sequence
  HCDR1
GFSLSSYA

SEQ ID NO: 2250 - protein, 7 aa, Artificial Sequence
  HCDR2
IWNNGAT

SEQ ID NO: 2251 - protein, 14 aa, Artificial Sequence
  HCDR3
ARSANDAWSTYSDL

SEQ ID NO: 2252 - protein, 6 aa, Artificial Sequence
  LCDR1
QTITNY

SEQ ID NO: 2253 - protein, 3 aa, Artificial Sequence
  LCDR2
KAS

SEQ ID NO: 2254 - protein, 14 aa, Artificial Sequence
  LCDR3
QNYYYGSSSGYGFV

SEQ ID NO: 2255 - protein, 8 aa, Artificial Sequence
  HCDR1
GFSLTYYA

SEQ ID NO: 2256 - protein, 7 aa, Artificial Sequence
  HCDR2
IYDNGAT

SEQ ID NO: 2257 - protein, 14 aa, Artificial Sequence
  HCDR3
ARSANNAWSTYSNL

SEQ ID NO: 2258 - protein, 6 aa, Artificial Sequence
  LCDR1
EDISSY

SEQ ID NO: 2259 - protein, 3 aa, Artificial Sequence
  LCDR2
KAS

SEQ ID NO: 2260 - protein, 14 aa, Artificial Sequence
  LCDR3
QSYYSGSISGYGFV

SEQ ID NO: 2261 - protein, 8 aa, Artificial Sequence
  HCDR1
GFTISSYH

SEQ ID NO: 2262 - protein, 8 aa, Artificial Sequence
  HCDR2
IYGGTATT

SEQ ID NO: 2263 - protein, 17 aa, Artificial Sequence
  HCDR3
ARARYSGGSYANYVFNL

SEQ ID NO: 2264 - protein, 6 aa, Artificial Sequence
  LCDR1
QSISSY

SEQ ID NO: 2265 - protein, 3 aa, Artificial Sequence
  LCDR2
RTS

SEQ ID NO: 2266 - protein, 14 aa, Artificial Sequence
  LCDR3
QGYDWSSSNRYDNT

SEQ ID NO: 2267 - protein, 8 aa, Artificial Sequence
  HCDR1
GFSLSRYD

SEQ ID NO: 2268 - protein, 7 aa, Artificial Sequence
  HCDR2
ISSSGGT

SEQ ID NO: 2269 - protein, 11 aa, Artificial Sequence
  HCDR3
AREGDYWDFNL

SEQ ID NO: 2270 - protein, 6 aa, Artificial Sequence
  LCDR1
QSISNL

SEQ ID NO: 2271 - protein, 3 aa, Artificial Sequence
  LCDR2
GAS

SEQ ID NO: 2272 - protein, 12 aa, Artificial Sequence
  LCDR3
AGGFPGLDTVAA

SEQ ID NO: 2273 - protein, 8 aa, Artificial Sequence
  HCDR1
GFTISDFH

SEQ ID NO: 2274 - protein, 8 aa, Artificial Sequence
  HCDR2
IITSASTT

SEQ ID NO: 2275 - protein, 15 aa, Artificial Sequence
  HCDR3
ARSTYTDTSGYYFDF

SEQ ID NO: 2276 - protein, 8 aa, Artificial Sequence
  LCDR1
QSIYNGNR

SEQ ID NO: 2277 - protein, 3 aa, Artificial Sequence
  LCDR2
SAS

SEQ ID NO: 2278 - protein, 13 aa, Artificial Sequence
  LCDR3
LGSYDCDSADCFA

SEQ ID NO: 2279 - protein, 8 aa, Artificial Sequence
  HCDR1
GFSLSSYA

SEQ ID NO: 2280 - protein, 7 aa, Artificial Sequence
  HCDR2
ISTSGIT

SEQ ID NO: 2281 - protein, 15 aa, Artificial Sequence
  HCDR3
ARLNGFDDYVRYFDF

SEQ ID NO: 2282 - protein, 6 aa, Artificial Sequence
  LCDR1
ESIASN

SEQ ID NO: 2283 - protein, 3 aa, Artificial Sequence
  LCDR2
AAS

SEQ ID NO: 2284 - protein, 12 aa, Artificial Sequence
  LCDR3
QSAFYVSSSDNA

SEQ ID NO: 2285 - protein, 8 aa, Artificial Sequence
  HCDR1
GFSLSSYD

SEQ ID NO: 2286 - protein, 7 aa, Artificial Sequence
  HCDR2
IGSDGSA

SEQ ID NO: 2287 - protein, 12 aa, Artificial Sequence
  HCDR3
ARDWNDYWAHDL

SEQ ID NO: 2288 - protein, 8 aa, Artificial Sequence
  LCDR1
QIVTSKSA

SEQ ID NO: 2289 - protein, 3 aa, Artificial Sequence
  LCDR2
KAS

SEQ ID NO: 2290 - protein, 12 aa, Artificial Sequence
  LCDR3
AGGYYNSGDLNP

SEQ ID NO: 2291 - protein, 8 aa, Artificial Sequence
  HCDR1
GFSLSSYD

SEQ ID NO: 2292 - protein, 7 aa, Artificial Sequence
  HCDR2
ISSSGNT

SEQ ID NO: 2293 - protein, 11 aa, Artificial Sequence
  HCDR3
AREGDYWDFNL

SEQ ID NO: 2294 - protein, 6 aa, Artificial Sequence
  LCDR1
QSISNL

SEQ ID NO: 2295 - protein, 3 aa, Artificial Sequence
  LCDR2
RAS

SEQ ID NO: 2296 - protein, 12 aa, Artificial Sequence
  LCDR3
AGGFPGLDTGAT

SEQ ID NO: 2297 - protein, 8 aa, Artificial Sequence
  HCDR1
GFSLNDYW

SEQ ID NO: 2298 - protein, 7 aa, Artificial Sequence
  HCDR2
IDVGGSL

SEQ ID NO: 2299 - protein, 11 aa, Artificial Sequence
  HCDR3
ARGGLTYGFDL

SEQ ID NO: 2300 - protein, 6 aa, Artificial Sequence
  LCDR1
EDISSY

SEQ ID NO: 2301 - protein, 3 aa, Artificial Sequence
  LCDR2
GAS

SEQ ID NO: 2302 - protein, 12 aa, Artificial Sequence
  LCDR3
HYYATISGLGVA

SEQ ID NO: 2303 - protein, 8 aa, Artificial Sequence
  HCDR1
GFSLSTYA

SEQ ID NO: 2304 - protein, 7 aa, Artificial Sequence
  HCDR2
VYDNGYI

SEQ ID NO: 2305 - protein, 14 aa, Artificial Sequence
  HCDR3
ARSADGSWSTYFNL

SEQ ID NO: 2306 - protein, 6 aa, Artificial Sequence
  LCDR1
ESISNY

SEQ ID NO: 2307 - protein, 3 aa, Artificial Sequence
  LCDR2
KAS

SEQ ID NO: 2308 - protein, 14 aa, Artificial Sequence
  LCDR3
QTNYCCSSSDNGFA

SEQ ID NO: 2309 - protein, 8 aa, Artificial Sequence
  HCDR1
GIDLSSYH

SEQ ID NO: 2310 - protein, 7 aa, Artificial Sequence
  HCDR2
IAYGGNT

SEQ ID NO: 2311 - protein, 12 aa, Artificial Sequence
  HCDR3
ARGYSEDSYWGL

SEQ ID NO: 2312 - protein, 6 aa, Artificial Sequence
  LCDR1
QNIENY

SEQ ID NO: 2313 - protein, 3 aa, Artificial Sequence
  LCDR2
DTS

SEQ ID NO: 2314 - protein, 12 aa, Artificial Sequence
  LCDR3
QQDYGIIFVDNI

SEQ ID NO: 2315 - protein, 8 aa, Artificial Sequence
  HCDR1
GFSLSDYY

SEQ ID NO: 2316 - protein, 7 aa, Artificial Sequence
  HCDR2
MSGSGST

SEQ ID NO: 2317 - protein, 18 aa, Artificial Sequence
  HCDR3
ARDGDYAGWGYATGAFDP

SEQ ID NO: 2318 - protein, 8 aa, Artificial Sequence
  LCDR1
QSVVGNSL

SEQ ID NO: 2319 - protein, 3 aa, Artificial Sequence
  LCDR2
SAS

SEQ ID NO: 2320 - protein, 12 aa, Artificial Sequence
  LCDR3
TGRYNSDTDTFV

SEQ ID NO: 2321 - protein, 141 aa, Artificial Sequence
  VH
MGWSWIFLFLLSGTAGVLSEVQLQQSGPDLVKPGASVKISCKTSGYTFTEYIMHWVKQSHGKSLEWIGGIIPNNGGTSYNQKFKDKATMTVDKSSSTGYMELRSLTSEDSAVYYCTRREVYGRNYYALDYWGQGTLVTVSS

SEQ ID NO: 2322 - protein, 127 aa, Artificial Sequence
  VL
MRAPAQFLGLLLLCFQGTRCDIQMTQTTSSLSASLGDRVTITCSASQGINNYLNWYQQKPDGTVKLLIYYTSSLHSGVPSRFSGSGSGTDYSLTISNLEPEDIATYYCQQYSNLPYTFGGGTKLEIK

SEQ ID NO: 2323 - protein, 8 aa, Artificial Sequence
  HCDR1
GYTFTEYI

SEQ ID NO: 2324 - protein, 8 aa, Artificial Sequence
  HCDR2
IIPNNGGT

SEQ ID NO: 2325 - protein, 15 aa, Artificial Sequence
  HCDR3
TRREVYGRNYYALDY

SEQ ID NO: 2326 - protein, 6 aa, Artificial Sequence
  LCDR1
QGINNY

SEQ ID NO: 2327 - protein, 3 aa, Artificial Sequence
  LCDR2
YTS

SEQ ID NO: 2328 - protein, 9 aa, Artificial Sequence
  LCDR3
QQYSNLPYT

The invention claimed is:

1. A method for inducing T cell activation in a subject, comprising administering to a subject in need of T cell activation an antibody comprising at least two binding domains, wherein a first binding domain binds to a first receptor of the tumor necrosis factor (TNF) superfamily and a second binding domain binds to a second receptor of the TNF superfamily, wherein the first receptor and the second receptor are different, the first binding domain binds to CD40 and is selected from a first group consisting of:
   (a) light and heavy chain complementarity determining regions wherein
      the heavy chain complementary determining region 1 (HCDR1) includes the amino acid sequence of SEQ ID NO: 2323, the HCDR2 includes the amino acid sequence of SEQ ID NO: 2324 and the HCDR3 includes the amino acid sequence of SEQ ID NO: 2325;
      the light chain complementarity determining region 1 (LCDR1) includes the amino acid sequence of SEQ ID NO: 2326, the LCDR2 includes the amino acid sequence of SEQ ID NO: 2327 and the LCDR3 includes the amino acid sequence of SEQ ID NO: 2328; and
   (b) a heavy chain variable domain (VH) having the amino acid sequence of SEQ ID NO: 2321, and a light chain variable domain (VL) having the amino acid sequence of SEQ ID NO: 2322; and the second binding domain binds to 4-1BB (CD137) and is selected from a second group consisting of:
   (a) light and heavy chain complementarity determining regions wherein
      the heavy chain complementary determining region 1 (HCDR1) includes the amino acid sequence of SEQ ID NO: 2297, the HCDR2 includes the amino acid sequence of SEQ ID NO: 2298 and the HCDR3 includes the amino acid sequence of SEQ ID NO: 2299, and
      the light chain complementarity determining region 1 (LCDR1) includes the amino acid sequence of SEQ ID NO: 2300, the LCDR2 includes the amino acid sequence of SEQ ID NO: 2301 and the LCDR3 includes the amino acid sequence of SEQ ID NO: 2302;
   (b) a heavy chain variable domain (VH) having the amino acid sequence of SEQ ID NO: 2241 and a light chain variable domain (VL) having the amino acid sequence of SEQ ID NO: 2242;
   (c) light and heavy chain complementarity determining regions wherein
      the heavy chain complementarity determining region HCDR1 includes the amino acid sequence of SEQ ID NO: 2255, the HCDR2 includes the amino acid sequence of SEQ ID NO: 2256 and the HCDR3 includes the amino acid sequence of SEQ ID NO: 2257, and
      the light chain complementarity determining region LCDR1 includes the amino acid sequence of SEQ ID NO: 2258, the LCDR2 includes the amino acid sequence of SEQ ID NO: 2259 and the LCDR3 includes the amino acid sequence of SEQ ID NO: 2260;
   (d) a heavy chain variable domain (VH) having the amino acid sequence of SEQ ID NO: 2227 and a light chain variable domain (VL) having the amino acid sequence of SEQ ID NO: 2228;
   (e) light and heavy chain complementarity determining regions wherein
      the heavy chain complementarity determining region HCDR1 includes the amino acid sequence of SEQ ID NO: 2315, the HCDR2 includes the amino acid sequence of SEQ ID NO: 2316 and the HCDR3 includes the amino acid sequence of SEQ ID NO: 2317, and
      the light chain complementarity determining region LCDR1 includes the amino acid sequence of SEQ ID NO: 2318, the LCDR2 includes the amino acid sequence of SEQ ID NO: 2319 and the LCDR3 includes the amino acid sequence of SEQ ID NO: 2320; and
   (f) a heavy chain variable domain (VH) having the amino acid sequence of SEQ ID NO: 2247 and a light chain variable domain (VL) having the amino acid sequence of SEQ ID NO: 2248.

2. A method of treating cancer by inducing T cell activation in a subject in need of treatment, said method comprising administering to the subject an antibody comprising at least two binding domains, wherein the first binding domain binds to CD40 and is selected from a first group consisting of:
   (a) light and heavy chain complementarity determining regions wherein
      the heavy chain complementary determining region 1 (HCDR1) includes the amino acid sequence of SEQ ID NO: 2323, the HCDR2 includes the amino acid sequence of SEQ ID NO: 2324 and the HCDR3 includes the amino acid sequence of SEQ ID NO: 2325;
      the light chain complementarity determining region 1 (LCDR1) includes the amino acid sequence of SEQ ID NO: 2326, the LCDR2 includes the amino acid sequence of SEQ ID NO: 2327 and the LCDR3 includes the amino acid sequence of SEQ ID NO: 2328; and (b) a heavy chain variable domain (VH) having the amino acid sequence of SEQ ID NO: 2321, and a light chain variable domain (VL) having the amino acid sequence of SEQ ID NO: 2322; and the second binding domain binds to 4-1BB (CD137) and is selected from a second group consisting of:
  (a) light and heavy chain complementarity determining regions wherein
    the heavy chain complementary determining region 1 (HCDR1) includes the amino acid sequence of SEQ ID NO: 2297, the HCDR2 includes the amino acid sequence of SEQ ID NO: 2298 and the HCDR3 includes the amino acid sequence of SEQ ID NO: 2299, and
    the light chain complementarity determining region 1 (LCDR1) includes the amino acid sequence of SEQ ID NO: 2300, the LCDR2 includes the amino acid sequence of SEQ ID NO: 2301 and the LCDR3 includes the amino acid sequence of SEQ ID NO: 2302;
  (b) a heavy chain variable domain (VH) having the amino acid sequence of SEQ ID NO: 2241 and a light chain variable domain (VL) having the amino acid sequence of SEQ ID NO: 2242;
  (c) light and heavy chain complementarity determining regions wherein
    the heavy chain complementarity determining region HCDR1 includes the amino acid sequence of SEQ ID NO: 2255, the HCDR2 includes the amino acid sequence of SEQ ID NO: 2256 and the HCDR3 includes the amino acid sequence of SEQ ID NO: 2257, and
    the light chain complementarity determining region LCDR1 includes the amino acid sequence of SEQ ID NO: 2258, the LCDR2 includes the amino acid sequence of SEQ ID NO: 2259 and the LCDR3 includes the amino acid sequence of SEQ ID NO: 2260;
  (d) a heavy chain variable domain (VH) having the amino acid sequence of SEQ ID NO: 2227 and a light chain variable domain (VL) having the amino acid sequence of SEQ ID NO: 2228;
  (e) light and heavy chain complementarity determining regions wherein
    the heavy chain complementarity determining region HCDR1 includes the amino acid sequence of SEQ ID NO: 2315, the HCDR2 includes the amino acid sequence of SEQ ID NO: 2316 and the HCDR3 includes the amino acid sequence of SEQ ID NO: 2317, and
    the light chain complementarity determining region LCDR1 includes the amino acid sequence of SEQ ID NO: 2318, the LCDR2 includes the amino acid sequence of SEQ ID NO: 2319 and the LCDR3 includes the amino acid sequence of SEQ ID NO: 2320; and
  (f) a heavy chain variable domain (VH) having the amino acid sequence of SEQ ID NO: 2247 and a light chain variable domain (VL) having the amino acid sequence of SEQ ID NO: 2248.

3. A method of treating a virus infection by inducing T cell activation in a subject in need of treatment, said method comprising administering to the subject an antibody comprising at least two binding domains, wherein
the first binding domain binds to CD40 and is selected from a first group consisting of:
  (a) light and heavy chain complementarity determining regions wherein
    the heavy chain complementary determining region 1 (HCDR1) includes the amino acid sequence of SEQ ID NO: 2323, the HCDR2 includes the amino acid sequence of SEQ ID NO: 2324 and the HCDR3 includes the amino acid sequence of SEQ ID NO: 2325;
    the light chain complementarity determining region 1 (LCDR1) includes the amino acid sequence of SEQ ID NO: 2326, the LCDR2 includes the amino acid sequence of SEQ ID NO: 2327 and the LCDR3 includes the amino acid sequence of SEQ ID NO: 2328; and
  (b) a heavy chain variable domain (VH) having the amino acid sequence of SEQ ID NO: 2321, and a light chain variable domain (VL) having the amino acid sequence of SEQ ID NO: 2322; and the second binding domain binds to 4-1BB (CD137) and is selected from a second group consisting of:
  (a) light and heavy chain complementarity determining regions wherein
    the heavy chain complementary determining region 1 (HCDR1) includes the amino acid sequence of SEQ ID NO: 2297, the HCDR2 includes the amino acid sequence of SEQ ID NO: 2298 and the HCDR3 includes the amino acid sequence of SEQ ID NO: 2299, and
    the light chain complementarity determining region 1 (LCDR1) includes the amino acid sequence of SEQ ID NO: 2300, the LCDR2 includes the amino acid sequence of SEQ ID NO: 2301 and the LCDR3 includes the amino acid sequence of SEQ ID NO: 2302;
  (b) a heavy chain variable domain (VH) having the amino acid sequence of SEQ ID NO: 2241 and a light chain variable domain (VL) having the amino acid sequence of SEQ ID NO: 2242;
  (c) light and heavy chain complementarity determining regions wherein
    the heavy chain complementarity determining region HCDR1 includes the amino acid sequence of SEQ ID NO: 2255, the HCDR2 includes the amino acid sequence of SEQ ID NO: 2256 and the HCDR3 includes the amino acid sequence of SEQ ID NO: 2257, and
    the light chain complementarity determining region LCDR1 includes the amino acid sequence of SEQ ID NO: 2258, the LCDR2 includes the amino acid sequence of SEQ ID NO: 2259 and the LCDR3 includes the amino acid sequence of SEQ ID NO: 2260;
  (d) a heavy chain variable domain (VH) having the amino acid sequence of SEQ ID NO: 2227 and a light chain variable domain (VL) having the amino acid sequence of SEQ ID NO: 2228;
  (e) light and heavy chain complementarity determining regions wherein
    the heavy chain complementarity determining region HCDR1 includes the amino acid sequence of SEQ ID NO: 2315, the HCDR2 includes the amino acid sequence of SEQ ID NO: 2316 and the HCDR3 includes the amino acid sequence of SEQ ID NO: 2317, and
    the light chain complementarity determining region LCDR1 includes the amino acid sequence of SEQ ID NO: 2318, the LCDR2 includes the amino acid sequence of SEQ ID NO: 2319 and the LCDR3 includes the amino acid sequence of SEQ ID NO: 2320; and (f) a heavy chain variable domain (VH) having the amino acid sequence of SEQ ID NO: 2247 and a light chain variable domain (VL) having the amino acid sequence of SEQ ID NO: 2248.

\* \* \* \* \*